United States Patent 7,745,391 (HUMAN THROMBOSPONDIN POLYPEPTIDE) - sequence listing, part 285

SEQ ID NO: 892354 - protein, 481 aa, Homo sapiens
MTGRRPLSQATGAVVSRPVTWQGPLRRSFSEDTLMDGPARIEPLRARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 892355 - protein, 140 aa, Homo sapiens [sequence omitted]

SEQ ID NO: 892356 - protein, 576 aa, Homo sapiens
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 892357 - protein, 456 aa, Homo sapiens
MQVPQDGEDLAGQPWYHGLLSRQKAEALLQQNGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMESAPGTPSPAYPPWPVPGAPSWEHRPSPAIGRLPGHRPPGSDQRSAGQHGSLIWPGAAHSSPWTPLEVGTAGETLALHLCRHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 892358 - protein, 407 aa, Homo sapiens [sequence omitted]

SEQ ID NO: 892359 - protein, 142 aa, Homo sapiens
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQLVYKQYFKSNFPARAAYQVAALPKGSRIEIEAVAIQGPLTTASL

SEQ ID NO: 892360 - protein, 142 aa, Homo sapiens; identical to SEQ ID NO: 892359

SEQ ID NO: 892361 - protein, 142 aa, Homo sapiens; identical to SEQ ID NO: 892359

SEQ ID NO: 892362 - protein, 119 aa, Homo sapiens
MSSLIRRVISTAKAPGAIGPYSQAVLVDRTIYISGQIGMDPSSGQLVSGGVAEEAKQALKNMGEILKAAGCDFTNVVYKQYFKSNFPARAAYQVAALPKGSRIEIEAVAIQGPLTTASL

SEQ ID NO: 892363 - protein, 104 aa, Homo sapiens
MDPSSGQLVSGGVAEEAKQALKNMGEILKAAGCDFTNVVKTTVLLADINDFNTVNEIYKQLVYKQYFKSNFPARAAYQVAALPKGSRIEIEAVAIQGPLTTASL

SEQ ID NO: 892364 - protein, 143 aa, Homo sapiens
ELWGRGAAVVGQSSKKPAGLVLGLLLLKGLQEGRLSHVVLDQKGDQHRESPRGHWTLQALKNMGEILKAAGCDFTNVVKTTVLLADINDFNTVNEIYKQLVYKQYFKSNFPARAAYQVAALPKGSRIEIEAVAIQGPLTTASL

SEQ ID NO: 892365 - protein, 91 aa, Homo sapiens
ELWGRGAAVVGQSSKKPAGLVLGLLLLKGLQEGRLSHVVLDQKGDQHRESPRGHWTLQSSCISRQDHLHFRTDRHGPFKWTACVRRGSRRS

SEQ ID NO: 892366 - protein, 261 aa, Homo sapiens
KSRAVTVAGVRPSSPHGLVGAVSVGGAGVMAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKSAGFVITIFKL

SEQ ID NO: 892367 - protein, 1202 aa, Homo sapiens
KSRAVTVAGVRPSSPHGLVGAVSVGGAGVMAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVNFTYQFLKKKFYIFSQFMYDEHIKSRLIKDIRFFREIKDQNDHKYPFDRAEKFNRGIRKLGITPEGQSYLDQFRQLISQIGNAMGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKKNKIGAAFTDDGFAMGVAYILKLLDQYREFDSLHWFQSVREKYLKEIRAVAKQQNVQSASQDEKLLQTMNLTQKRLDVYLQEFELLYFSLSSARIFFRADKTAAEENQEKKEKEEETKTSNGDLSDSTVSADPVVK

SEQ ID NO: 892368 - protein, 1202 aa, Homo sapiens; identical to SEQ ID NO: 892367

SEQ ID NO: 892369 - protein, 1046 aa, Homo sapiens [sequence omitted]

SEQ ID NO: 892370 - protein, 1159 aa, Homo sapiens
KSRAVTVAGVRPSSPHGLVGAVSVGGAGVMAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVNFTYQFLKKKFYIFSQFMYDEHIKSRLIKDIRFFREIKDQNDHKYPFDRAEKFNRGIRKLGITPEGQSYLDQFRQLISQIGNAMGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKKNKIGAAFTDDGFAMGVAYILKLLDQYREFDSLHWFQSVREKYLKEIRAVAKQQNVQSASQDEKLLQTMNLTQKRLDVYLQCKNFLQSRQDCG

SEQ ID NO: 892371 - protein, 1202 aa, Homo sapiens; identical to SEQ ID NO: 892367

SEQ ID NO: 892372 - protein, 1202 aa, Homo sapiens; identical to SEQ ID NO: 892367

SEQ ID NO: 892373 - protein, 1235 aa, Homo sapiens
KSRAVTVAGVRPSSPHGLVGAVSVGGAGVMAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVNFTYQFLKKKFYIFSQFMYDEHIKSRLIKDIRFFREIKDQNDHKYPFDRAEKFNRGIRKLGITPEGQSYLDQFRQLISQIGHVGSRDGAVKKTKAVLMDLELKVGEDADRKIHSNAMGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKKNKIGAAFTDDGFAMGVAYILKLLDQYREFDSLHWFQSVREKYLKEIRAVAKQQNVQSASQDEKLLQTMNLTQKRLDVYLQEFELLYFSLSSARIFFRADKTAAEENQEKKEKEEETKTSNGDLSDSTVSADPVVK

SEQ ID NO: 892374 - protein, 251 aa, Homo sapiens [sequence omitted]

SEQ ID NO: 892375 - protein, 880 aa, Homo sapiens
KSRAVTVAGVRPSSPHGLVGAVSVGGAGVMAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTKWAFTAWRGGPRL

SEQ ID NO: 892376 - protein, 877 aa, Homo sapiens
KSRAVTVAGVRPSSPHGLVGAVSVGGAGVMAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVRTFLWGLSG

SEQ ID NO: 892377 - protein, 150 aa, Homo sapiens
QKLARAQERWGKRVRGGQMNSTVRQLRVPSHVPLRDPSWESLRNVPKLKKSRGMQGEQGRRLFRLLLNDLPGRDRLPCSYPQPHVEQASTSASPRLLAVNIPEDTLLSYPESSLPLQRHCAFHRFSKVLSELCPRCLPSTPCAIPFFFAW

SEQ ID NO: 892378 - protein, 168 aa, Homo sapiens
QKLARAQERWGKRVRGGQMNSTVRQLRVPSHVPLRDPSWESLRNVPKLKKSRGMQGEQGRRLFRLLLNDLPGRDRLPCSYPQPHVEQASTSASPRLLAVNIPEDTLLSYPESSLPLQRHCAFHRFSKVLSELCPRCLPSTPCAIPFFLASPFCLSHGLPQTVLSVFAW

SEQ ID NO: 892379 - protein, 1025 aa, Homo sapiens
RRSPLEGLHNLTLESRMDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDHLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLSILSKCCHAMVALIYPFAWQHTYIPVLPPAMVDIVCSPTPFLIGLLSSSLPLLRELPLEEVLVVDLVNSRFLRQMDDEDSILPRKLQVALEHILEQRNELACEQDEGPLDGRHGPESSPLNEVVSEAFVRFFVEIVGHYSLFLTSGEREERTLQREAFRKAVSSKSLRHFLEVFMETQMFRGFIQERELRRQDAKGLFEVRAQEYLETLPSGEHSGVNKFLKGLGNKMKFLHKK

SEQ ID NO: 892380 - protein, 213 aa, Homo sapiens
LIPFDYYYAARRQKGGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLSTPTSRCCHPPWSTSCARRRPSSSGCSPARCHCSGSCRWKSPCGLTLVKQPVSLDRMDLRTSICPPEKL

SEQ ID NO: 892381 - protein, 1025 aa, Homo sapiens; identical to SEQ ID NO: 892379

SEQ ID NO: 892382 - protein, 242 aa, Homo sapiens
SPCSLPGCSILSKCCHAMVALIYPFAWQHTYIPVLPPAMVDIVCSPTPFLIGLLSSSLPLLRELPLEEVLVVDLVNSRFLRQMDDEDSILPRKLQVALEHILEQRNELACEQDEGPLDGRHGPESSPLNEVVSEAFVRFFVEIVGHYSLFLTSGEREERTLQREAFRKAVSSKSLRHFLEVFMETQMFRGFIQERELRRQDAKGLFEVRAQEYLETLPSGEHSGVNKFLKGLGNKMKFLHKK

SEQ ID NO: 892383 - protein, 359 aa, Homo sapiens
LIPFDYYYAARRQKGGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFAFPASGEEGHLHCRQAQHTYIPVLPPAMVDIVCSPTPFLIGLLSSSLPLLRELPLEEVLVVDLVNSRFLRQMDDEDSILPRKLQVALEHILEQRNELACEQDEGPLDGRHGPESSPLNEVVSEAFVRFFVEIVGHYSLFLTSGEREERTLQREAFRKAVSSKSLRHFLEVFMETQMFRGFIQERELRRQDAKGLFEVRAQEYLETLPSGEHSGVNKFLKGLGNKMKFLHKK

SEQ ID NO: 892384 - protein, 811 aa, Homo sapiens
RRSPLEGLHNLTLESRMDMFSLDMIISDPAAEASRAGKKQLRGVQNPCPSARARPRHKSLNIKDKISEWEGKKEVPTPAPSRRADGQEDYLPSSTVERRSSDGVRTQVTEAKNGMRPGTESTEKERNKGAVNVGGQDPEPGQDLSQPEREVDPSWGRGREPRLGKLRFQNDHLSVLKQVKKLEQALKDGSAGLDPQLPGTCYSPHCPPDKAEAGSTLPENLGGGSGSEVSQRVHPSDLEGREPTPELVEDRKGSCRRPWDRSLENVYRGSEGSPTKPFINPLPKPRRTFKHAGEGDKDGKPGIGFRKEKRNLPPLPSLPPPPLPSSPPPSSVNRRLWTGRQKSSADHRKSYEFEDLLQSSSESSRVDWYAQTKLGLTRTLSEENVYEDILDPPMKENPYEDIELHGRCLGKKCVLNFPASPTSSIPDTLTKQSLSKPAFFRQNSERRNFKLLDTRKLSRDGTGSPSKISPPSTPSSPDDIFFNLGDPQNGRKKRKIPKLVLRINAIYEVRRGKKRVKRLSQSMESNSGKVTDENSESDSDTEEKLKAHSQRLVNVKSRLKQAPRYPSLARELIEYQERQLFEYFVVVSLHKKQAGAAYVPELTQQFPLKLERSFKFMREAEDQLKAIPQFCFPDAKDWVPVQQFTSETFSFVLTGEDGSRRFGYCRRLLPGGKGKRLPEVYCIVSRLGCFSLFSRILDEVEKRRGISPALVQPLMRSVMEAPFPALGKTILVKNFLPGSGTEVIELCRPLDSRLEHVDFESLFSSLSVRHLVCVFASLLLERRVIFIADKLRYPPWLLLLKRLNDSRSWTL

SEQ ID NO: 892385 - protein, 349 aa, Homo sapiens
MQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKVSSHSQPPLGPAEMSLR

SEQ ID NO: 892386 - protein, 911 aa, Homo sapiens
ASGAAGAHRLKSRLSASAGRSSPALGQGRWDRGAGGEPWRGPGPRTLGAAAPPGGPAASVTSRGGASAAAWALSRAPGEQRKAEPRGAHSVAPMERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 892387 - protein, 528 aa, Homo sapiens
ASPPAARSPPASASPPGAQSPLASASASPPAAPPPPASVCPPEAPPPPASASPPAALSPPASALPPAGYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 892388 - protein, 493 aa, Homo sapiens
MVLLSHQGPSALGSRVVLPKVGEPMTRDSSAPQTRLPDSPRQPRMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGPSSAQAQASSPTLSCLDNATEALPADSGPGPTPDEPCMTTWTCQSSQLRWEPTEGSHPCCR

SEQ ID NO: 892389 - protein, 77 aa, Homo sapiens
GTVMAWWGGAGTRQHCLALLMSLLASFQAKSSEEMGHWLGLLLSESGSKTDPEEFTYDYVDADRVSCIVSAAKNSLL

SEQ ID NO: 892390 - protein, 911 aa, Homo sapiens; identical to SEQ ID NO: 892386

SEQ ID NO: 892391 - protein, 758 aa, Homo sapiens
MVLLSHQGPSALGSRVVLPKVGEPMTRDSSAPQTRLPDSPRQPRMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 892392 - protein, 927 aa, Homo sapiens
ASGAAGAHRLKSRLSASAGRSSPALGQGRWDRGAGGEPWRGPGPRTLGAAAPPGGPAASVTSRGGASAAAWALSRAPGEQRKAEPRGAHSVAPMERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKVETFHLLSLPHFWRVVYQFSNTCS

SEQ ID NO: 892393 - protein, 113 aa, Homo sapiens
MPQTHSLLQVEPTEEATPVADDPNERESDRVYLDLTPVKSFLHGPSSAQAQASSPTLSCLDNATEALPADSGPGPTPDEPCIKCPENLGEQVQASPAGQQDHLPAPLQPAESG

SEQ ID NO: 892394 - protein, 152 aa, Homo sapiens
MGFAEAFLEHLWKNLQDPSNPAIIRQAAGNYIGSFLARAKFISLITVKPCLDLLVNWLHIYLNNQDSGTKAFCDVALHGPFYSACQAVFYTFVFRHKQLLSGNLKEGLQYPQSLNFERIVMSQLNPLKICLPSVVNFFAAITKMKTCGYGWW

SEQ ID NO: 892395 - protein, 480 aa, Homo sapiens
MIVADSECRAELKDYLRFAPGGVGDSGPGEEQRESRARRGPRGPSAFIPVEEVLREGAESLEQHLGLEALMSSGRVDNLAVVMGLHPDYFTSFWRLHYLLLHTDGPLASSWRHYIAIMAAARHQCSYLVGSHMAEFLQTGGDPEWLLGLHRAPEKLRKLSEINKLLAHRPWLITKEHIQALLKTGEHTWSLAELIQALVLLTHCHSLSSFVFGCGILPEGDADGSPAPQAPTPPSEQSSPPSRDPLNNSGGFESARDVEALMERMQQLQESLLRDEGTSQEEMESRFELEKSESLLVTPSADILEPSPHPDMLCFVEDPTFGYEDFTRRGAQAPPTFRAQDYTWEDHGYSLIQRLYPEGGQLLDEKFQAAYSLTYNTIAMHSGVDTSVLRRAIWNYIHCVFGIRYDDYDYGEVNQLLERNLKVYIKTVACYPEKTTRRMYNLFWRHFRHSEKVHVNLLLLEARMQAALLYALRAITRYMT

SEQ ID NO: 892396 - protein, 469 aa, Homo sapiens
MIVADSECRAELKDYLRFAPGGVGDSGPGEEQRESRARRGPRGPSAFIPVEEVLREGAESLEQHLGLEALMSSGRVDNLAVVMGLHPDYFTSFWRLHYLLLHTDGPLASSWRHYIAIMAAARHQCSYLVGSHMAEFLQTGGDPEWLLGLHRAPEKLRKLSEINKLLAHRPWLITKEHIQALLKTGEHTWSLAELIQALVLLTHCHSLSSFVFGCGILPEGDADGSPAPQAPTPPSEQSSPPSRDPLNNSGGFESARDVEALMERMQQLQEEMESRFELEKSESLLVTPSADILEPSPHPDMLCFVEDPTFGYEDFTRRGAQAPPTFRAQDYTWEDHGYSLIQRLYPEGGQLLDEKFQAAYSLTYNTIAMHSGVDTSVLRRAIWNYIHCVFGIRYDDYDYGEVNQLLERNLKVYIKTVACYPEKTTRRMYNLFWRHFRHSEKVHVNLLLLEARMQAALLYALRAITRYMT

SEQ ID NO: 892397 - protein, 97 aa, Homo sapiens
GEVNQLLIIIVIISDAKDSSGYDDYDYGEVNQLLERNLKVYIKTVACYPEKTTRRMYNLFWRHFRHSEKVHVNLLLLEARMQAALLYALRAITRYMT

SEQ ID NO: 892398 - protein, 121 aa, Homo sapiens
MIVADSECRAELKDYLRFAPGGVGDSGPGEEQRESRARRGPRGPSAFIPVEEVLREGAESLEQHLGLEALMSSGRVDNLAVVMGLHPDYFLMLSWAALHLLLACTTGIGPLWPKLPWAPYI

SEQ ID NO: 892399 - protein, 480 aa, Homo sapiens; identical to SEQ ID NO: 892395

SEQ ID NO: 892400 - protein, 491 aa, Homo sapiens
MIVADSECRAELKDYLRFAPGGVGDSGPGEEQRESRARRGPRGPSAFIPVEEVLREGAESLEQHLGLEALMSSGRVDNLAVVMGLHPDYFTSFWRLHYLLLHTDGPLASSWRHYIAIMAAARHQCSYLVGSHMAEFLQTGGDPEWLLGLHRAPEKLRKLSEINKLLAHRPWLITKEHIQALLKTGEHTWSLAELIQALVLLTHCHSLSSFVFGCGILPEGDADGSPAPQAPTPPSEQSSPPSRDPLNNSGGFESARDVEALMERMQQLQESLLRDEGTSQEEMESRFELEKSESLLVTPSADILEPSPHPDMLCFVEDPTFGYEDSLSGDSPRPFCVPCPPSPRCSGLVCDVQSRSHTLPFPHWNGQFIALTLGSQPCSWELEEHLEILRDHTLPPSPAHRGRGHRKEAGPSSELMCHKCCGLPELGSPWLAPGGEGQMPPGLTLQAALPSLPCHFQISLPPTCHSPINVKVRVTAGLCVQFPKSLFCWAA

SEQ ID NO: 892401 - protein, 74 aa, Homo sapiens
HLGLEALMSSGRVDNLAVVMGLHPDYFTSFWRLHYLLLHTDGPLASSWRHYIAIMVSLSGPDTWRGGFVVGSVL

SEQ ID NO: 892402 - protein, 171 aa, Homo sapiens
MASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVATGVLNLHVECERVTGLEGDPIWEMPGTWL

SEQ ID NO: 892403 - protein, 102 aa, Homo sapiens
MTHSRCLHNPFFRSAQRWIAALAGTLPVLLLLLGGAGYFLWQQQEEKKTQFRKKKREQELREMAWSTMKQEQSTRVKLLEELSKFPFPQRPRHVFLSLLYAP

SEQ ID NO: 892404 - protein, 332 aa, Homo sapiens
MASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 892405 - protein, 332 aa, Homo sapiens; identical to SEQ ID NO: 892404

SEQ ID NO: 892406 - protein, 332 aa, Homo sapiens; identical to SEQ ID NO: 892404

SEQ ID NO: 892407 - protein, 267 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIAESLQEELKRKKIQYLTRGEESSSDTNKSA

SEQ ID NO: 892408 - protein, 267 aa, Homo sapiens; identical to SEQ ID NO: 892407

SEQ ID NO: 892409 - protein, 267 aa, Homo sapiens; identical to SEQ ID NO: 892407

SEQ ID NO: 892410 - protein, 332 aa, Homo sapiens; identical to SEQ ID NO: 892404

SEQ ID NO: 892411 - protein, 262 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIAESLQEELSKLPFPQRSRHVFLSSL

SEQ ID NO: 892412 - protein, 311 aa, Homo sapiens
MASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRGIQRKQRI

SEQ ID NO: 892413 - protein, 292 aa, Homo sapiens
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 892414 - protein, 225 aa, Homo sapiens
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIAESLQEELKRKKIQYLTRGEESSSDTNKSA

SEQ ID NO: 892415 - protein, 226 aa, Homo sapiens [sequence omitted]

SEQ ID NO: 892416 - protein, 332 aa, Homo sapiens; identical to SEQ ID NO: 892404

SEQ ID NO: 892417 - protein, 329 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELSKLPFPQRSRHVFLSSL

SEQ ID NO: 892418 - protein, 332 aa, Homo sapiens; identical to SEQ ID NO: 892404

SEQ ID NO: 892419 - protein, 267 aa, Homo sapiens; identical to SEQ ID NO: 892407

SEQ ID NO: 892420 - protein, 349 aa, Homo sapiens
MASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGEEMLQMRLHFV

SEQ ID NO: 892421 - protein, 506 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRDGEVSSMHLGERDIAAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892422 - protein, 504 aa, Homo sapiens
MASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRDGEVSSMHLGERDIAAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892423 - protein, 562 aa, Homo sapiens
LTVSHGEKTIFAFSFSFLPDERLSHNRKNGELLIDRLYSVGSDSPMGIPRDGFPYWNPKVKTLKDRHFWQSFPLVLTAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892424 - protein, 518 aa, Homo sapiens
LTVSHGEKTIFAFSFSFLPDERLSHNRKNGELLIDRLYSVGSDSPMGIPRDGFPYWNPKVKTLKDRHFWQSSVFCAWTLWAHPGHDGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892425 - protein, 556 aa, Homo sapiens
LTVSHGEKTIFAFSFSFLPDERLSHNRKNGELLIDRLYSVGSDSPMGIPRDGFPYWNPKVKTLKDRHFWQRDPPPCASAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRDGEVSSMHLGERDIAAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892426 - protein, 281 aa, Homo sapiens
MASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQPGSQPGRDRLILLVISAEQLSCGTPEGITGVRGTMGN

SEQ ID NO: 892427 - protein, 118 aa, Homo sapiens
LTVSHGEKTIFAFSFSFLPDERLSHNRKNGELLIDRLYSVGSDSPMGIPRDGFPYWNPKVKTLKDRHFWQSIDENGKFPGFPSAQLSCLPPLGPAAHSLLSTALPRPSIMRWSPTPVP

SEQ ID NO: 892428 - protein, 83 aa, Homo sapiens
LAMHPAPPMTQGAKPDIFEKVPPLIHQSCRGGKLDPGRDSKEKERKHVVRGEWSGKSTKILTFFLSVSPSFQNGKMALFKPGE

SEQ ID NO: 892429 - protein, 332 aa, Homo sapiens; identical to SEQ ID NO: 892404

SEQ ID NO: 892430 - protein, 315 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 892431 - protein, 226 aa, Homo sapiens [sequence omitted]

SEQ ID NO: 892432 - protein, 229 aa, Homo sapiens
VSIFPGFKSTACKVGHAEEVFQKPVSLACPECGFEWRYCVLGCESFMSERHYWEVEVGDRKEWHIGVCSKNVERKKVWVKMTPENGYWTMGLTDGNKYRALTEPRTNLKLPEPPRKVGVILDYETGHISFYNATDGSHIYTFLHASSSEPLYPVFRILTLEPTALTVCPIPKVESSPDPDLVPDHSLEIPLTPGLANESGEPQAEVTSLLLPAQPGAKGLTLHNSQSEP

SEQ ID NO: 892433 - protein, 325 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTREWL

SEQ ID NO: 892434 - protein, 511 aa, Homo sapiens
MASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892435 - protein, 349 aa, Homo sapiens
MASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGEEMLQMRLHFV

SEQ ID NO: 892436 - protein, 504 aa, Homo sapiens; identical to SEQ ID NO: 892422

SEQ ID NO: 892437 - protein, 254 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIAGQYLLGLRFSELGCGS

SEQ ID NO: 892438 - protein, 215 aa, Homo sapiens
MASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASRSPKVLGLQA

SEQ ID NO: 892439 - protein, 212 aa, Homo sapiens
MEHNEARTKHKRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892440 - protein, 224 aa, Homo sapiens
DRILGCSTMKQEQCTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 892441 - protein, 977 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 892442 - protein, 1335 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSVSDLSGDPGLSFPAGGVWVLESGNEPSAWGKALHSPRRGTPRVDGSKMITSCPSSPSHMLGGHTEGTTALSDGRIQVSESEVTSPVLVASLVSRLSPVLSLKEHLGRARWLMPVIPALWEAELGGSQGQEIETILANTVKPRLYYKIQKISRVWWWAPVVPATREAEAEEWHETREAEFAVSRDRATAFQPGRQSETPSQKKENNNKRTSDEGPGVVAHAYNPSTLGGRGVQITRSGVRDQPGQHGDTPSLLKIQKLAGCSGWTPVIPGTQEAEAGESLESRRRRLQCAEIVPLHSSMGNKSKTPSQKKNPFYLFRDLYTSTKAILWGEWGRSDYCTLQVWSAEAGLVFGKEFSALPSPGSRGCSRPCLTCVGVQKGAWYLERTSQLCQVLAGGAAAPGSPSCVGVERSPAWLMGPEPHRPQRGGEGAAGCYPRLAERVSCCLFADMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 892443 - protein, 639 aa, Homo sapiens
MGNKSKTPSQKKNPFYLFRDLYTSTKAILWGEWGRSDYCTLQVWSAEAGLVFGKEFSALPSPGSRGCSRPCLTCVGVQKGAWYLERTSQLCQVLAGGAAAPGSPSCVGVERSPAWLMGPEPHRPQRGGEGAAGCYPRLAERVSCCLFADMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 892444 - protein, 977 aa, Homo sapiens; identical to SEQ ID NO: 892441

SEQ ID NO: 892445 - protein, 498 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKCRG

SEQ ID NO: 892446 - protein, 208 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQVGSGLNQPVSVYPL

SEQ ID NO: 892447 - protein, 1033 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMVTPPPCMLGAAVGAVVLSLTWEGQPGGPSRPALSLSEVGGPGRGVGEQAPMMAVPQMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 892448 - protein, 957 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQAASSATPRQAPGLATTPTVRALSTSASGTSCSAGSGARRTRPGSGSGPGPLRPASWAPTTCAKEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 892449 - protein, 1118 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMVTPPPCMLGAAVGAVVLSLTWEGQPGGPSRPALSLSEVGGPGRGVGEQAPMMAVPQMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLPLELGHPAAGLLSDCPQPNFSWHSDVPPLLFFSATLFHHSIIWSAGLLVCPWSLGFMAYMGAGQEAWRAKRQLLGHKNRNAYSHLGPQDPGLEAGPLHGDHPL

SEQ ID NO: 892450 - protein, 199 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKRGLEASKVSSCGAKERTCSDKEVTPLLFLLLQGVQKWFTSEETLMFCMRVMVGVIILYDHVHPVGAFCKTSKIDMKG

SEQ ID NO: 892451 - protein, 824 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 892452 - protein, 797 aa, Homo sapiens
MLPDFPSPSTWAPGLLLPSGPALLSPSVLQDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 892453 - protein, 285 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWPSAPGAAGAEDVSRGHHGFGKDWIGGTWDLTLVGVCGLGTLVLGPQGAAVGAAGEWSPRAPAFPQIRSFSVLSSSFPSQSPFSLSWCLCPSLCLQTLSSILHFGVRTSGVWRRCGSRDR

SEQ ID NO: 892454 - protein, 443 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 892455 - protein, 135 aa, Homo sapiens
MALARTGLGGHGTLRLWGSAGWELSSSVPRAQLLGLRGSGAPVPLLFLRSVLSLCCPPPSLPSLPFLSPGVSAPLCACKPYPLFFTLGSELRGCGGGAALGTGNVGFQVMPSCHSPAIYKGILIFIVNLKGSSHP

SEQ ID NO: 892456 - protein, 403 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSECESGSEGDGTVHRRKKRRTCSMVGNGDTTSQDDCVSKERSSSR

SEQ ID NO: 892457 - protein, 85 aa, Homo sapiens
MTALHLGESDQYLCCLPRSEVCLMKKWVASRLTPCFLSSCVQCESGSEGDGTVHRRKKRRTCSMVGNGDTTSQDDCVSKERSSSR

SEQ ID NO: 892458 - protein, 96 aa, Homo sapiens
MNHKSKKRIREAKRSARPELKDSLDWTRHNYYESFSLSPAAVAVSGSGGGGQAGHRHLQPLRTFLWARGCPRPERPGPRRGSPAPRGVWGPRGADS

SEQ ID NO: 892459 - protein, 315 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYSR

SEQ ID NO: 892460 - protein, 403 aa, Homo sapiens; identical to SEQ ID NO: 892456

SEQ ID NO: 892461 - protein, 315 aa, Homo sapiens; identical to SEQ ID NO: 892459

SEQ ID NO: 892462 - protein, 315 aa, Homo sapiens; identical to SEQ ID NO: 892459

SEQ ID NO: 892463 - protein, 85 aa, Homo sapiens; identical to SEQ ID NO: 892457

SEQ ID NO: 892464 - protein, 414 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSECESGSEGDGTVHRRKKRRTCSMVGNGDTTSQDDCVSKERSSSRIRDTCGGRAHP

SEQ ID NO: 892465 - protein, 335 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRYSTGSGSASHPQPPRATVSQP

SEQ ID NO: 892466 - protein, 315 aa, Homo sapiens; identical to SEQ ID NO: 892459

SEQ ID NO: 892467 - protein, 103 aa, Homo sapiens
MAVSALEQHFLPLRILKQEHPELAVLADSVDLQESTGIASDSSSDSSSSSSSSSSDSDSECESGSEGDGTVHRRKKRRTCSMVGNGDTTSQDDCVSKERSSSR

SEQ ID NO: 892468 - protein, 255 aa, Homo sapiens [sequence omitted]

SEQ ID NO: 892469 - protein, 255 aa, Homo sapiens [sequence omitted]

SEQ ID NO: 892470 - protein, 104 aa, Homo sapiens
MKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 892471 - protein, 255 aa, Homo sapiens [sequence omitted]

SEQ ID NO: 892472 - protein, 119 aa, Homo sapiens
MPFITCDEFNGVPSYMKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 892473 - protein, 188 aa, Homo sapiens
PSAFSAPGKPHPPEAKMSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 892474 - protein, 201 aa, Homo sapiens
RPDGRPSSTHPASPSAFSAPGKPHPPEAKMSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 892475 - protein, 192 aa, Homo sapiens
CEPSLRLSPHQGKPHPPEAKMSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 892476 - protein, 188 aa, Homo sapiens; identical to SEQ ID NO: 892473

SEQ ID NO: 892477 - protein, 188 aa, Homo sapiens; identical to SEQ ID NO: 892473

SEQ ID NO: 892478 - protein, 188 aa, Homo sapiens; identical to SEQ ID NO: 892473

SEQ ID NO: 892479 - protein, 188 aa, Homo sapiens; identical to SEQ ID NO: 892473

SEQ ID NO: 892480 - protein, 147 aa, Homo sapiens
RPDGRPSSTHPASPSAFSAPGKPHPPEAKMSSKRAKAKTTKKRPQRATSNVFAMFDQSQIQEFKEAFNMIDQNRDGFIDKEDLHDMLASLGFIHEDHLRELLTTMGDRFTDEEVDEMYREAPIDKKGNFNYVEFTRILKHGAKDKDD

SEQ ID NO: 892481 - protein, 188 aa, Homo sapiens; identical to SEQ ID NO: 892473

SEQ ID NO: 892482 - protein, 188 aa, Homo sapiens; identical to SEQ ID NO: 892473

SEQ ID NO: 892483 - protein, 188 aa, Homo sapiens; identical to SEQ ID NO: 892473

SEQ ID NO: 892484 - protein, 188 aa, Homo sapiens; identical to SEQ ID NO: 892473

SEQ ID NO: 892485 - protein, 147 aa, Homo sapiens; identical to SEQ ID NO: 892480

SEQ ID NO: 892486 - protein, 125 aa, Homo sapiens
MLSSSQNPLPPVSHGAVKGRGGGRGCKLSQLGTEGPGPPGWNTPPATGKNPTDEYLEGMMSEAPGPINFTMFLTMFGEKLNGTDPEDVIRNAFACFDEEASGPWRPLPPLCMQVEQGPGIQCLCP

SEQ ID NO: 892487 - protein, 89 aa, Homo sapiens
CEPSLRLSPHQGKPHPPEAKMSSKRAKAKTTKKRPQRATSNVFAMFDQSQIQEFKEAFNMIDQNRDGFIDKEDLHDMLASLGELGQGQG

SEQ ID NO: 892488 - protein, 230 aa, Homo sapiens
DPTAGPVPRTQRAQAPSPHQELSGTESVNPYCWALLMSPVPDEDSRAQRGKPHPPEAKMSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 892489 - protein, 188 aa, Homo sapiens; identical to SEQ ID NO: 892473

SEQ ID NO: 892490 - protein, 188 aa, Homo sapiens; identical to SEQ ID NO: 892473

SEQ ID NO: 892491 - protein, 182 aa, Homo sapiens
RPDGRPSSTHPASPSAFSAPGKPHPPEAKMSSKRAKAKTTKKRPQRATSNVFAMFDQSQIQEFKEAFNMIDQNRDGFIDKEDMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 892492 - protein, 188 aa, Homo sapiens; identical to SEQ ID NO: 892473

SEQ ID NO: 892493 - protein, 188 aa, Homo sapiens; identical to SEQ ID NO: 892473

SEQ ID NO: 892494 - protein, 188 aa, Homo sapiens; identical to SEQ ID NO: 892473

SEQ ID NO: 892495 - protein, 201 aa, Homo sapiens; identical to SEQ ID NO: 892474

SEQ ID NO: 892496 - protein, 211 aa, Homo sapiens
MDDETKAQGRTGGRDQGDDKKRGRRATGKKKRARRQGGTQREGGGGKGRGERRSRDERQHERRSENTNTESPHRKTTRTRNHRSPEGPNTTPPPERKQGNQHQKEPAESQTRSRDDNEEHNHDGRAAHHSAAAGGKAAAPPTPRRGAAPARARAGTRPGGGRGRTGTGKKGRTGEGAREARGGRQHAKRTADRRGAAETRPDRGKNGDDID

SEQ ID NO: 892497 - protein, 240 aa, Homo sapiens
MCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892498 - protein, 1109 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 892499 - protein, 1100 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFVSAGRCHLGTCQVNSLSSPHVSQAQQETYLGFWINSKKSQCNIFLSGTY

SEQ ID NO: 892500 - protein, 282 aa, Homo sapiens
HKIFNEGLGARGKKNGCTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892501 - protein, 204 aa, Homo sapiens
MKLYTVVLGCYFISFEETKSSSTVKEEKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFVSAGRCHLGTCQVNSLSSPHVSQAQQETYLGFWINSKKSQCNIFLSGTY

SEQ ID NO: 892502 - protein, 371 aa, Homo sapiens
CNDSLNLPPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892503 - protein, 1069 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892504 - protein, 372 aa, Homo sapiens
HHETLSEFSPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892505 - protein, 328 aa, Homo sapiens
MCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892506 - protein, 444 aa, Homo sapiens
CNDSLNLPPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFSTASDMRFEDTFYGADIIQGERKRQRVLSSRFKNEYVADPVYRTFLKSSFQKKCQKRQ

SEQ ID NO: 892507 - protein, 389 aa, Homo sapiens
CNDSLNLPPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTVGAPEVHTSQVHAHQTVLQQN

SEQ ID NO: 892508 - protein, 435 aa, Homo sapiens
CNDSLNLPPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAMKREDIYTLDEELPKRVKARFVSAGRCHLGTCQVNSLSSPHVSQAQQETYLGFWINSKKSQCNIFLSGTY

SEQ ID NO: 892509 - protein, 745 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIFIVKKI

SEQ ID NO: 892510 - protein, 745 aa, Homo sapiens; identical to SEQ ID NO: 892509

SEQ ID NO: 892511 - protein, 817 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASKWIYNSSITGFSAFHIIFISHFFGTCQICCMDYWHS

SEQ ID NO: 892512 - protein, 630 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSVCGNIHFLPYSLYGESTF

SEQ ID NO: 892513 - protein, 219 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGTFIFTVSFVKIIGCDSFVTI

SEQ ID NO: 892514 - protein, 114 aa, Homo sapiens
ASHPPPRREGEARRSDRAAGVLCACAANSCHLVRNKSPKFPKSPWAGGHCLLFLLHRVVLSPQPARQVTAFPESGGQGGGRVRRGLPGTAPLRVGHGGAGVRASGDAGAETLRP

SEQ ID NO: 892515 - protein, 384 aa, Homo sapiens
GDCEGLQTGERAFELHDSLNPPRLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDA

SEQ ID NO: 892516 - protein, 885 aa, Homo sapiens
PHTTCITHLSIYNEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLCTCRKDMVKISMDIFVRKFQPDRYQLWKQGKDIYTIDHTKPTPASTPEVKAWLQRRRKVRKASRSFQCARSTSKRPKADEEEEVSDEVDGAEVPNPDSVTDDLKVSEKSEAAVKLRNTEASSEEESSASRMQVEQNLSDHIKLSGNSCLSTSVTEDIKTEDDKAYAYRSVPSISSEADDSIPLSSGYEKPEKSDPSELSWPKSPESCSSVAESNGVLTEGEESDVESHGNGLEPGEIPAVPSGERNSFKVPSIAEGENKTSKSWRHPLSRPPARSPMTLVKQQAPSDEELPEVLSIEEEVEETESWAKPLIHLWQTKSPNFAAEQEYNATVARMKPHCAICTLLMPYHKPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGSQIAINTDAA

SEQ ID NO: 892517 - protein, 444 aa, Homo sapiens; identical to SEQ ID NO: 892506

SEQ ID NO: 892518 - protein, 372 aa, Homo sapiens
CNDSLNLPPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVFTAQSKHSKNESCIATTTSAAAAGATILCELGHKSKACEKVISVGQTVITKHRNTRYYSCRVMAVTSQTFYEVMFDDGSFSRDTFPEDIVSRDCLKLGPPAEGEVVQVKWPDGKLYGAKYFGSNIAHMYQVEFEDGPQRTQPSDKRE

SEQ ID NO: 892519 - protein, 256 aa, Homo sapiens
CNDSLNLPPLQPDSSNEENDARWETKLDEVVTSEGKTKPLIPEMCFIYSEENIEYSPPNAFLEEDGTSLLISCAKCCVRVHASCYGIPSHEICDGWLCARCKRNAWTAECCLCNLRGGALKQTKNNRWAHVMCAVAVPEVRFTNVPERTQIDVGRIPLQRLKLKCIFCRHRVKRVSGACIQCSYGRCPASFHVTCAHAAGVLMEPDDWPYVVNITCFRHKVNPNVGKMCPPFLSAKTVSGFSPVLDYLPDIMCFIL

SEQ ID NO: 892520 - protein, 421 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLVSYASKIKQKLNVYSGYFSRNPTILCSIYLFFLTGAMCLSPQQFTSGSIHLFYIANITNFS

SEQ ID NO: 892521 - protein, 403 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEGVDEWNIARLNTVLDVVEEECGISIEGVNTPYLYFGMWKTTFAWHTEDMDLYSINYLHFGEPKSWYAIPPEHGKRLERLAQGFFPSSSQGCDAFLRHKMTLISPSVLKKYGIPFDKITQEAGEFMITFPYGYHAGFNHGFNCAESTNFATVRWIDYGKVAKLVSYASKIKHIYLFFLTGAMCLSPQQFTSGSIHLFYIANITNFS

SEQ ID NO: 892522 - protein, 204 aa, Homo sapiens
GPVRVRSEQLSPSAEQVSQISQISLGRRPLSSLPPPPSRALAPTRAPDTALTIMEVAEVESPLNPSCKIMTFRPSMEEFREFNKYLAYMESKGAHRAGLAKVIPPKEWKPRQCYDDIDNLLIPAPIQQMVTGQSGLFTQYNIQKKAMTVKEFRQLANSGKYCTPRYLDYEDLERKYWKNLTFVAPIYGADINGSIYDEVSSCAL

SEQ ID NO: 892523 - protein, 112 aa, Homo sapiens
MTGLLGFGRSCILAGQTGPVVSGAQVSSWRERQPCSGSRGPSHILGTDANAGTADHKGEQQEAPSKHPQMALDISHILRNMSCSGRAKASTLPCRNSSDYVATILELHALIV

SEQ ID NO: 892524 - protein, 109 aa, Homo sapiens
KLGLVSFPGFRKKPTRSVLQNETFVSRSTADCKWLPFVAVSILSILRLDWFLLLALPCPTDHKGEQQEAPSKHPQMALDISHILRNILITSCWAKAQQPDFRNILIIFY

SEQ ID NO: 892525 - protein, 152 aa, Homo sapiens
KLGLVSFPGFRKKPTRSVLQNETFVSRSTADCKWLPFVAVSILSILRLDWFLLLALPCPTDHKGEQQEAPSKHPQMALDISHILRNMSCSGRAKASSKACGAGGSQARWGNPEPWGLPMGIGRSQGRVRGSTGGVRESPRALLAQGAVNTMD

SEQ ID NO: 892526 - protein, 152 aa, Homo sapiens; identical to SEQ ID NO: 892525

SEQ ID NO: 892527 - protein, 152 aa, Homo sapiens; identical to SEQ ID NO: 892525

SEQ ID NO: 892528 - protein, 152 aa, Homo sapiens; identical to SEQ ID NO: 892525

SEQ ID NO: 892529 - protein, 282 aa, Homo sapiens
VAGERRAGMAEQWELDEEGIRRLGALTLEQPETGSCYVAQAGLELLDSSNPVSASPVTETTELVESLSLQGSYAGKIHSIGDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQGNVFTLLLIC

SEQ ID NO: 892530 - protein, 762 aa, Homo sapiens
VAGERRAGMAEQWELDEEGIRRLGALTLEQPELVESLSLQGSYAGKIHSIGDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 892531 - protein, 365 aa, Homo sapiens [sequence omitted]

SEQ ID NO: 892532 - protein, 602 aa, Homo sapiens
VAGERRAGMAEQWELDEEGIRRLGALTLEQPELVESLSLQGSYAGKIHSIGDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGKFEAKTGQSAGGKPHFVRKNSTVGGRCCHLNCEWATVTYL

SEQ ID NO: 892533 - protein, 437 aa, Homo sapiens
MTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSELSLVTWVVCTVWLETTVPPSLPEPPMWPLSSDSSWSLWISTGMAPAPSSSTRSFSESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 892534 - protein, 486 aa, Homo sapiens
MLRPRFLPPDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 892535 - protein, 446 aa, Homo sapiens
VAGERRAGMAEQWELDEEGIRRLGALTLEQPDSNKGLFIPFPNREIKDSLSTSATQGNGTRDQKLDTFPLGTQTQEVARREMPSDNHQEDDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 892536 - protein, 187 aa, Homo sapiens
MVVVGGGGVGKSALTIQFIQSYFVSDYDPTIEDSYTKICSVDGIPARLDILDTAGQEEFGAMREQYMRAGHGFLLVFAINDRQSFNEVGKLFTQILRVKDRDDFPVVLVGNKADLESQRQVPRSEASAFGASHHVAYFEASAKLRLNVDEAFEQLVRAVRKYQEQELPPSPPSAPRKKGGGCPCVLL

SEQ ID NO: 892537 - protein, 218 aa, Homo sapiens
MSSGAASGTGRGRPRGGGPGPGDPPPSETHKLVVVGGGGVGKSALTIQFIQSYFVSDYDPTIEDSYTKICSVDGIPARLDILDTAGQEEFGAMREQYMRAGHGFLLVFAINDRQSFNEVGKLFTQILRVKDRDDFPVVLVGNKADLESQRQVPRSEASAFGASHHVAYFEASAKLRLNVDEAFEQLVRAVRKYQEQELPPSPPSAPRKKGGGCPCVLL

SEQ ID NO: 892538 - protein, 218 aa, Homo sapiens; identical to SEQ ID NO: 892537

SEQ ID NO: 892539 - protein, 194 aa, Homo sapiens
HFDLAERLTESRVLVVGKSALTIQFIQSYFVSDYDPTIEDSYTKICSVDGIPARLDILDTAGQEEFGAMREQYMRAGHGFLLVFAINDRQSFNEVGKLFTQILRVKDRDDFPVVLVGNKADLESQRQVPRSEASAFGASHHVAYFEASAKLRLNVDEAFEQLVRAVRKYQEQELPPSPPSAPRKKGGGCPCVLL

SEQ ID NO: 892540 - protein, 146 aa, Homo sapiens
MAPLPVSAVLDTAGQEEFGAMREQYMRAGHGFLLVFAINDRQSFNEVGKLFTQILRVKDRDDFPVVLVGNKADLESQRQVPRSEASAFGASHHVAYFEASAKLRLNVDEAFEQLVRAVRKYQEQELPPSPPSAPRKKGGGCPCVLL

SEQ ID NO: 892541 - protein, 218 aa, Homo sapiens; identical to SEQ ID NO: 892537

SEQ ID NO: 892542 - protein, 83 aa, Homo sapiens
SSSARVRVGNLESQRLVPRSEASAFGASHHVAYFEASAKLRLNVDEAFEQLVRAVRKYQEQELPPSPPSAPRKKGGGCPCVLL

SEQ ID NO: 892543 - protein, 314 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKKGDEVQCEIEELGVIINKVV

SEQ ID NO: 892544 - protein, 314 aa, Homo sapiens; identical to SEQ ID NO: 892543

SEQ ID NO: 892545 - protein, 314 aa, Homo sapiens; identical to SEQ ID NO: 892543

SEQ ID NO: 892546 - protein, 314 aa, Homo sapiens; identical to SEQ ID NO: 892543

SEQ ID NO: 892547 - protein, 296 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKVG

SEQ ID NO: 892548 - protein, 265 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQ

SEQ ID NO: 892549 - protein, 178 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKIHTT

SEQ ID NO: 892550 - protein, 265 aa, Homo sapiens; identical to SEQ ID NO: 892548

SEQ ID NO: 892551 - protein, 269 aa, Homo sapiens
VPAEMTVGNLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKKGDEVQCEIEELGVIINKVV

SEQ ID NO: 892552 - protein, 178 aa, Homo sapiens; identical to SEQ ID NO: 892549

SEQ ID NO: 892553 - protein, 290 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQGCHPNWDPPRCRCIQETSCLSQEGG

SEQ ID NO: 892554 - protein, 202 aa, Homo sapiens [sequence omitted]

SEQ ID NO: 892555 - protein, 185 aa, Homo sapiens
MVCSLSAWTVGPEATAAHCSSPTLQEVDWEVELAVVIGKKGKHIKATDAMAHVAGFTVAHDVSARDWQMRRNGKQWLLGKTFDTFCPLGPALVTKDSVADPHNLKICCRVNGEVVQSGNTNQMVFKTEDLIAWVSQFVTFYPGDVILTGTPPGVGVFRKPPVFLKKGDEVQCEIEELGVIINKVV

SEQ ID NO: 892556 - protein, 178 aa, Homo sapiens; identical to SEQ ID NO: 892549

SEQ ID NO: 892557 - protein, 193 aa, Homo sapiens
VISSGLGFIVYTGPVLHSLDRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQEVDWEVELAVVIGKKGKHIKIHTT

SEQ ID NO: 892558 - protein, 172 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPKEPIIFSKFASSIVGPYDEVVLPPQSQVSVSPLPSLVTGPITRAF

SEQ ID NO: 892559 - protein, 268 aa, Homo sapiens
MLVSGRRRLLTVLLQAQKWPFQPSRDMRLVQFRAPHLVGPHLGLETGNGGGVINLNAFDPTLPKTMTQFLEQGEATLSVARRALAAQLPVLPRSEVTFLAPVTRPDKVVCVGMNYVDHCKEQNVPVPCTGPAHRMRASAPTQPSPGKGPVTGVDRCQPCKPPLLGRREKDRALFNKFVRSKQKKKGTNTQPQANQTHTKGNKKRQNTREHTPQPTRAPYADKKPRASTRPREGRQKRKRNNTQTTKRGAPSAKEQRTTDTEKEHTTHS

SEQ ID NO: 892560 - protein, 134 aa, Homo sapiens
MRASAPTQPSPGKGPVTGVDRCQPCKPPLLGRREKDRALFNKFVRSKQKKKGTNTQPQANQTHTKGNKKRQNTREHTPQPTRAPYADKKPRASTRPREGRQKRKRNNTQTTKRGAPSAKEQRTTDTEKEHTTHS

SEQ ID NO: 892561 - protein, 191 aa, Homo sapiens
SVSSCSLYQDHTIVREAWSGPRPQSSPCGLPQEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKTRRPQNQERLCGLQVFCLLLSKKTIGGKVKETTAFSIPVSYSACVPFSVFMEEAQGRGKEGR

SEQ ID NO: 892562 - protein, 47 aa, Homo sapiens
MERRELTLVTSSDSNSVYIISFKPFILGRKILVLSPAVPPLGVFFGS

SEQ ID NO: 892563 - protein, 229 aa, Homo sapiens
PCQFSSFRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 892564 - protein, 385 aa, Homo sapiens
CVFGARAGCAPSAFAPPAPEALLLPLCPSPRRASRANMGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 892565 - protein, 403 aa, Homo sapiens
CVFGARAGCAPSAFAPPAPEALLLPLCPSPRRASRANMGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEDEGSGSDEDENDEGNDEDYSSPASEGGCKKKKSKVPSRNSADDEELTNDSLTLSQSKSNEDSLILEKSQNWSSPKMDHILICCVCWADDSEDR

SEQ ID NO: 892566 - protein, 101 aa, Homo sapiens
CVFGARAGCAPSAFAPPAPEALLLPLCPSPRRASRANMGQEEELLRIAKKLEKMVARKNTEGALDLLKKLHSCQMSIQLLQTTRIGVAVNGVRKHCSGNGQ

SEQ ID NO: 892567 - protein, 199 aa, Homo sapiens
CVFGARAGCAPSAFAPPAPEALLLPLCPSPRRASRANMGQEEELLRIAKKLEKMVARKNTEGALDLLKKLHSCQMSIQLLQTTRIGVAVNGVRKHCSDKEVVSLAKVLIKNWKRLLDSPGPPKGEKGEEREKAKKKEKGLECSDWKPEAGLSPPRKKTRRPQNQERLCGLQVFCLLLSKKTIGGKIKQQQIKSGEPQNT

SEQ ID NO: 892568 - protein, 385 aa, Homo sapiens; identical to SEQ ID NO: 892564

SEQ ID NO: 892569 - protein, 175 aa, Homo sapiens [sequence omitted]

SEQ ID NO: 892570 - protein, 195 aa, Homo sapiens
RVCLGPARVARPPPSRLLPPRPYCCPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 892571 - protein, 385 aa, Homo sapiens; identical to SEQ ID NO: 892564

SEQ ID NO: 892572 - protein, 199 aa, Homo sapiens; identical to SEQ ID NO: 892567

SEQ ID NO: 892573 - protein, 218 aa, Homo sapiens
GTRLSVWPHLPRPLIRFLTNFLFPQVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGEASVQLMLPWSLYPTLSQALAHAQHLYSALAATVSSWNLENLSLEGIAE

SEQ ID NO: 892574 - protein, 1115 aa, Homo sapiens
IIDRRRAAELVGGPDGDVRLRPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892575 - protein, 1090 aa, Homo sapiens
HYLTKSPSGPGTDLGHNHYCEQGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892576 - protein, 1242 aa, Homo sapiens
IIDRRRAAELVGGPDGDVRLRPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGVSDRPVSTLLPLSCPVLPHLAPSCHPWVRGQGPGPCFTVFLIPGAQQDGPTTYSLPLFVFAQFLLDGKVLSLTDFQVGVVGGRGLLGEDTKGGRWGENRGLAGDRVFLVQWKVGSRLLAGLGKAEVLPGSNLSLLPVVTCQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892577 - protein, 989 aa, Homo sapiens
MGPSGAALGVLILRGNELRSLHGLEQLRNLRHLDLAYNLLEGHRELSPLWLLAELRKLYLEGNPLWFHPEHRAATAQYLSPRARDAATGVSDRPVSTLLPLSCPVLPHLAPSCHPWVRGQGPGPCFTVFLIPGAQQDGPTTYSLPLFVFAQFLLDGKVLSLTDFQVGVVGGRGLLGEDTKGGRWGENRGLAGDRVFLVQWKVGSRLLAGLGKAEVLPGSNLSLLPVVTCQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892578 - protein, 1163 aa, Homo sapiens
IIDRRRAAELVGGPDGDVRLRPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGEASVQLMLPWSLYPTLSQALAHAQHLYSALAATVSSWNLENLSLEGIGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892579 - protein, 1115 aa, Homo sapiens; identical to SEQ ID NO: 892574

SEQ ID NO: 892580 - protein, 421 aa, Homo sapiens
CDLEDRVTGFEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892581 - protein, 572 aa, Homo sapiens
GCCVPCTGLGISFSLSLALGAEEGSLRGCKHSGSWAEEQGFCAGAWTSVQAFDRLQRSCHPPCSQHPLIPLITAPAVFHPGPPLAAQGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVSRLESFWALRVVCQEQLTALLAWIREPWEELFSIGLRTVIQEALALDR

SEQ ID NO: 892582 - protein, 1093 aa, Homo sapiens
IIDRRRAAELVGGPDGDVRLRPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTESPAVCPNCGSDHVVLLAVSRGTPNRERKQGEQSLAPSPFASPVCHPPGHGDHLDRAKNSPPQAPSTRDHGSWSLSPPPERCGLRSVDHRLRLFLDVEVFSDAQEEFQCCLKVPVALAGHTGEFMCLVVVSDRRLYLLKVTGEMREPPASWLQLTLAVPLQDLSGIELGLAGQSLRLEWAAGAGRCVLLPRDARHCRAFLEELLDVLQSLPPAWRNCVSATEEEVTPQHRLWPLLEKDSSLEARQFFYLRAFLVEGPSTCLVSLLLTPSTLFLLDEDAAGSPAEPSPPAASGEASEKVPPSGPGPAVRVREQQPLSSLSSVLLYRSAPEDLRLLFYDEVRKLRLGDVNQFAQSKVVEPGIESTVP

SEQ ID NO: 892583 - protein, 742 aa, Homo sapiens
IIDRRRAAELVGGPDGDVRLRPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTDQSALSLKKTLKKK

SEQ ID NO: 892584 - protein, 418 aa, Homo sapiens
IIDRRRAAELVGGPDGDVRLRPQRPVAMTTAQRDSLLWKLAGLLRESGDVVLSGCSTLSLLTPTLQQLNHVFELHLGPWGPGQTGFVALPSHPADSPVILQLQFLFDVLQKTLSLKLVHVAGPGPTGPIKIFPFKSLRHLELRGVPLHCLHGLRGIYSQLETLICSRSLQALEELLSACGGDFCSALPWLALLSANFSYNALTALDSSLRLLSALRFLNLSHNQVQDCQGFLMDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTHLWVLASEVPNDPGLKGEARE

SEQ ID NO: 892585 - protein, 263 aa, Homo sapiens
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTRPDSGTHGAF

SEQ ID NO: 892586 - protein, 317 aa, Homo sapiens [sequence omitted]

SEQ ID NO: 892587 - protein, 456 aa, Homo sapiens
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAGTDPSPSQQVHSLSSVLCDR

SEQ ID NO: 892588 - protein, 515 aa, Homo sapiens
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 892589 - protein, 515 aa, Homo sapiens; identical to SEQ ID NO: 892588

SEQ ID NO: 892590 - protein, 515 aa, Homo sapiens; identical to SEQ ID NO: 892588

SEQ ID NO: 892591 - protein, 515 aa, Homo sapiens; identical to SEQ ID NO: 892588

SEQ ID NO: 892592 - protein, 515 aa, Homo sapiens; identical to SEQ ID NO: 892588

SEQ ID NO: 892593 - protein, 317 aa, Homo sapiens [sequence omitted]

SEQ ID NO: 892594 - protein, 161 aa, Homo sapiens
MRHESLVKQAAKLLKNAQAFPRGLFNKEPDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 892595 - protein, 317 aa, Homo sapiens [sequence omitted]

SEQ ID NO: 892596 - protein, 456 aa, Homo sapiens; identical to SEQ ID NO: 892587

SEQ ID NO: 892597 - protein, 255 aa, Homo sapiens
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTET

SEQ ID NO: 892598 - protein, 515 aa, Homo sapiens; identical to SEQ ID NO: 892588

SEQ ID NO: 892599 - protein, 106 aa, Homo sapiens [sequence omitted]

SEQ ID NO: 892600 - protein, 515 aa, Homo sapiens; identical to SEQ ID NO: 892588

SEQ ID NO: 892601 - protein, 515 aa, Homo sapiens; identical to SEQ ID NO: 892588

SEQ ID NO: 892602 - protein, 515 aa, Homo sapiens; identical to SEQ ID NO: 892588

SEQ ID NO: 892603 - protein, 515 aa, Homo sapiens; identical to SEQ ID NO: 892588

SEQ ID NO: 892604 - protein, 283 aa, Homo sapiens
TTGCFWLEASHGLRLGEAWIESKDRSPHGGGGGASSVEGGGRLSRSFPAPHSHVFQGSHSEAGGGTAQSLCSQALGDGLPVTSRNQCVFIYRLRICVAPDLPASLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKVFPCPQACLLCWAAEIDV

SEQ ID NO: 892605 - protein, 394 aa, Homo sapiens [sequence omitted]

SEQ ID NO: 892606 - protein, 317 aa, Homo sapiens [sequence omitted]

SEQ ID NO: 892607 - protein, 132 aa, Homo sapiens
DSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 892608 - protein, 308 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 892609 - protein, 116 aa, Homo sapiens
MVSLRVGKKILPPGNNMPMWGLLGCSYKNSFAQKKQWGSPFRNSGNIFRPRGSVRERPPPFFFFFFFFFIKVVCCKCCTSRLHIRTLVILCFLGYNHDQSAMATTPLFALLQINCF

SEQ ID NO: 892610 - protein, 171 aa, Homo sapiens
RYPVVSIKTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 892611 - protein, 321 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRSRKLGQSETGFSQKNGKKPIFKNPLLENLVQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 892612 - protein, 95 aa, Homo sapiens
GLLNGCYQWLVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 892613 - protein, 134 aa, Homo sapiens
QGNRFTAIDPSMVMPSELEVQKGSLASARRSSIVPLAVNDELTRCVMYSQWHQHPQPAFSFRFVRLTGSHCVWEVGLMVIFMTGGISTKPVYLFPWIHLLQFHGTKYAAIDPSMVSAEELEVQKGSLGISQEEQ

SEQ ID NO: 892614 - protein, 280 aa, Homo sapiens [sequence omitted]

SEQ ID NO: 892615 - protein, 308 aa, Homo sapiens; identical to SEQ ID NO: 892608

SEQ ID NO: 892616 - protein, 281 aa, Homo sapiens
MGEIKVSPDYNWFRGTVPLKKIIVDDDDSKIWSLYDAGPRSIRCPLIFLPPVSGTADVFFRQILALTGWGYRVIAVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 892617 - protein, 266 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTDTFAAIPWNQIRGH

SEQ ID NO: 892618 - protein, 272 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 892619 - protein, 308 aa, Homo sapiens; identical to SEQ ID NO: 892608

SEQ ID NO: 892620 - protein, 223 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRGKDHDIGLGTHCIGNFHIYLVPEDRSVSQVCVRGIC

SEQ ID NO: 892621 - protein, 736 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 892622 - protein, 758 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSSSSVKCPSSCSCRVCSTLAIPLRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 892623 - protein, 550 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRAERGYLWEN

SEQ ID NO: 892624 - protein, 742 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTAEDKHFTRILYGPQLAMSNDLSNGNYSKADLQKHGEQGARVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 892625 - protein, 488 aa, Homo sapiens
MLAPSQTIPTRLQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 892626 - protein, 769 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSSSSVKCPSSCSCRVCSTLAIPLRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYRRRIRSITHLRLWGKSKQEGELPPKGFNVSDIQAH

SEQ ID NO: 892627 - protein, 107 aa, Homo sapiens
MSLLQPGPVFPSGNSENSDLTVLPNHICSKILSFSTFANHYFSCLLQICYAINLGKEIIEVQKDPEALAQLMLSIPLTNDGKYVLLNDQPDDDDGNPNEHRGAESEA

SEQ ID NO: 892628 - protein, 364 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQTSSNKKMNTTKDV

SEQ ID NO: 892629 - protein, 550 aa, Homo sapiens; identical to SEQ ID NO: 892623

SEQ ID NO: 892630 - protein, 550 aa, Homo sapiens; identical to SEQ ID NO: 892623

SEQ ID NO: 892631 - protein, 511 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGNNPPGWRAESANAEWTMCHKQHLQTDLPGPRTPVAIRDPTSRSQNRLCHPQLTPPFKQALATTPPTALAPQRKPGEIPANREHTDTL

SEQ ID NO: 892632 - protein, 287 aa, Homo sapiens
GRATLPVDPARPGAGPAGRRRRPLARRGRARGRRGHGVAAASPEPRAGECSRPPRLLPSVLPTQPSAEPRRTMPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQVGESLPEG

SEQ ID NO: 892633 - protein, 788 aa, Homo sapiens
MSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRRPHPHSLPRSSRCAPSV

SEQ ID NO: 892634 - protein, 110 aa, Homo sapiens
MTPATFVSIGRCVCSVGTDSSGAGEEAGGQEQHTDTGRQLVSEPALGPQELPCLDLGPAMRSPNASATKRRVPLGRLRTPLLMGSLQAKRQCNLVRWFPEFLSNLPFRFP

SEQ ID NO: 892635 - protein, 598 aa, Homo sapiens
MSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTPSWLVDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRRPHPHSLPRSSRCAPSV

SEQ ID NO: 892636 - protein, 849 aa, Homo sapiens
MSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRLSCQCGQATPSNSELTHYQLPQASSKTARHLYLDSHFLFSLKRTTLNLGSVPSCRNACLRWIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRRPHPHSLPRSSRCAPSV

SEQ ID NO: 892637 - protein, 636 aa, Homo sapiens
MRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRRPHPHSLPRSSRCAPSV

SEQ ID NO: 892638 - protein, 778 aa, Homo sapiens
MSDAQGSYKLDEAQAVLRETKAIKKAITCGEKEKQDLIKSLAMLKDGFRTDRGSHSDLWSSSSSLESSSFPLPKQYLDFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRRPHPHSLPRSSRCAPSV

SEQ ID NO: 892639 - protein, 788 aa, Homo sapiens; identical to SEQ ID NO: 892633

SEQ ID NO: 892640 - protein, 796 aa, Homo sapiens
MSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRFAEPEETRSQNVRKKKGARRGGSRL

SEQ ID NO: 892641 - protein, 637 aa, Homo sapiens
MSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTVSWDQVCHLPTRPHPDVGRESLSQNWR

SEQ ID NO: 892642 - protein, 641 aa, Homo sapiens
MSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSW

SEQ ID NO: 892643 - protein, 111 aa, Homo sapiens [sequence omitted]

SEQ ID NO: 892644 - protein, 746 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892645 - protein, 791 aa, Homo sapiens
ENKSRWRLGCRFWRSVRSRPTPGGTQKAVEPRCNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892646 - protein, 763 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892647 - protein, 723 aa, Homo sapiens
HSPALPSTIFHNTVFTWNQPSAKSLSLVVYSYNYYFWLDFPLQLPVVQPHSRLLYQLVDCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892648 - protein, 535 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVRYPIKMLLKELQT

SEQ ID NO: 892649 - protein, 327 aa, Homo sapiens
MKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892650 - protein, 224 aa, Homo sapiens
MLRREDVILSEKEEHTRLWAAHCRKIQLKKGQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892651 - protein, 802 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892652 - protein, 738 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNGMFQSWEAVSS

SEQ ID NO: 892653 - protein, 553 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHR

SEQ ID NO: 892654 - protein, 260 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDGMPDY

SEQ ID NO: 892655 - protein, 802 aa, Homo sapiens; identical to SEQ ID NO: 892651

SEQ ID NO: 892656 - protein, 717 aa, Homo sapiens
KIKAMAIGLPLLALGPVASDTRWDSEGSGAPAAAAAARGGDAREQRESARGTKCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892657 - protein, 793 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892658 - protein, 829 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLPSYLGTKWVYIACWILDRRFIEWHLQKEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 892659 - protein, 738 aa, Homo sapiens; identical to SEQ ID NO: 892652

SEQ ID NO: 892660 - protein, 738 aa, Homo sapiens; identical to SEQ ID NO: 892652

SEQ ID NO: 892661 - protein, 614 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECKYLLL

SEQ ID NO: 892662 - protein, 386 aa, Homo sapiens
ENKSRWRLGCRFWRSVRSRPTPGGTQKAVEPRRRRRRRAGATRGNNASRRAGRRIIMGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLPH

SEQ ID NO: 892663 - protein, 202 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 892664 - protein, 202 aa, Homo sapiens; identical to SEQ ID NO: 892663

SEQ ID NO: 892665 - protein, 202 aa, Homo sapiens; identical to SEQ ID NO: 892663

SEQ ID NO: 892666 - protein, 202 aa, Homo sapiens; identical to SEQ ID NO: 892663

SEQ ID NO: 892667 - protein, 216 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDGGLAPGCGLFLISSPQWGLVKSFSKK

SEQ ID NO: 892668 - protein, 142 aa, Homo sapiens
YVPRAILVDLEPGTMDSVRSGPFGQIFRPDNFVFESVWGRYKVVWSKDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 892669 - protein, 202 aa, Homo sapiens; identical to SEQ ID NO: 892663

SEQ ID NO: 892670 - protein, 202 aa, Homo sapiens; identical to SEQ ID NO: 892663

SEQ ID NO: 892671 - protein, 110 aa, Homo sapiens
MTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 892672 - protein, 212 aa, Homo sapiens
MPLPKVGGGFGGERSSLYTQYLSCTGILLLEYSYGKTFSSAIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 892673 - protein, 185 aa, Homo sapiens
EFELRSPSLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 892674 - protein, 202 aa, Homo sapiens; identical to SEQ ID NO: 892663

SEQ ID NO: 892675 - protein, 202 aa, Homo sapiens; identical to SEQ ID NO: 892663

SEQ ID NO: 892676 - protein, 202 aa, Homo sapiens; identical to SEQ ID NO: 892663

SEQ ID NO: 892677 - protein, 202 aa, Homo sapiens; identical to SEQ ID NO: 892663

SEQ ID NO: 892678 - protein, 202 aa, Homo sapiens; identical to SEQ ID NO: 892663

SEQ ID NO: 892679 - protein, 125 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLEH

SEQ ID NO: 892680 - protein, 139 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDSIFCNCEKCFWPLVS

SEQ ID NO: 892681 - protein, 186 aa, Homo sapiens [sequence omitted]

SEQ ID NO: 892682 - protein, 326 aa, Homo sapiens
DGSGSAGGARVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 892683 - protein, 326 aa, Homo sapiens; identical to SEQ ID NO: 892682

SEQ ID NO: 892684 - protein, 326 aa, Homo sapiens; identical to SEQ ID NO: 892682

SEQ ID NO: 892685 - protein, 326 aa, Homo sapiens; identical to SEQ ID NO: 892682

SEQ ID NO: 892686 - protein, 136 aa, Homo sapiens
DGSGSAGGARVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHNIWRTH

SEQ ID NO: 892687 - protein, 326 aa, Homo sapiens; identical to SEQ ID NO: 892682

SEQ ID NO: 892688 - protein, 326 aa, Homo sapiens; identical to SEQ ID NO: 892682

SEQ ID NO: 892689 - protein, 326 aa, Homo sapiens; identical to SEQ ID NO: 892682

SEQ ID NO: 892690 - protein, 299 aa, Homo sapiens
DGSGSAGGARVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGDVRLTPEDFARAQKYCKYAGSALQYEDVSTAVQNLQKALKLLTTGRE

SEQ ID NO: 892691 - protein, 326 aa, Homo sapiens; identical to SEQ ID NO: 892682

SEQ ID NO: 892692 - protein, 326 aa, Homo sapiens; identical to SEQ ID NO: 892682

SEQ ID NO: 892693 - protein, 198 aa, Homo sapiens
DGSGSAGGARVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNVIIFNL

SEQ ID NO: 892694 - protein, 157 aa, Homo sapiens
DGSGSAGGARVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDEV

SEQ ID NO: 892695 - protein, 255 aa, Homo sapiens
DGSGSAGGARVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGGKL

SEQ ID NO: 892696 - protein, 328 aa, Homo sapiens [sequence omitted]

SEQ ID NO: 892697 - protein, 400 aa, Homo sapiens
MKVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 892698 - protein, 368 aa, Homo sapiens
SVPDFLSVLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 892699 - protein, 328 aa, Homo sapiens [sequence omitted]

SEQ ID NO: 892700 - protein, 447 aa, Homo sapiens
AGGVRRAEFRFIAGLPTPIRQCTTTGLEGAGERIAKKYLYLHIMVDHYEVKRTYSHGTYRAGPMRQISLVGAVDEEVGDYFPEFLDMLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQCVQWVDDAKLNQLRREGIRYARIQLYDNDIYFIPRNVVHQFKTVSAVCSLAWHIRLKLYHSEEDTSQNTATHETGTSSDSTSSVLGPHTDNMICAVSKASLDSVFSDKLHSKYELQQIKHEPIASVRIKEEPVNVNIPEKTTALNNMDGKNVKAKLDHVQFAEFKIDMDSKFENSNKDLKEELCPGNLSLVDTRQHSSAHSNQDKKDDDILC

SEQ ID NO: 892701 - protein, 193 aa, Homo sapiens
SVPDFLSVLEESPFLKCTLPWGTLSSLKLQSRKDSDDGPIMWVRPGEQMIPVADMPKSPFKRKRTTNEIKNLQYLPRTSEPREMLFEDRTRAHADHIGQGFERQTTAAVGVLKAVHCGEWPDQPRITKDVICFHAEDFLEVVQRMQLDLHEPPLSQECCSSVQDSFSCMQFSMAYSAQIISLRGGHFSEYSYS

SEQ ID NO: 892702 - protein, 122 aa, Homo sapiens
EISFVIWILKLPCFLVLFFVSSCLDTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 892703 - protein, 183 aa, Homo sapiens
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 892704 - protein, 317 aa, Homo sapiens
HFLSRAGWVGTGSLPPPQRWPLPHCRPPGPPFNLVVEPCGFPAEPGPGLLPRGRGSPVPARPPPAPQVVQGREEPRPAPRGSSQRRPQAGALGAWAGSRVRAPRGSVGAGGEICHTSACCWQPSWTRLLLLITWMLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 892705 - protein, 201 aa, Homo sapiens
DLLYTISSAAGEEQKKAYKAYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 892706 - protein, 341 aa, Homo sapiens
HFLSRAGWVGTGSLPPPQRWPLPHCRPPGPPFNLVVEPCGFPAEPGPGLLPRGRGSPVPARPPPAPQVVQGREEPRPAPRGSSQRRPQAGALGAWAGSRVRAPRGSVGAGGEICHTSACCWQPSWTRLLLLITWMLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 892707 - protein, 212 aa, Homo sapiens
HFLSRAGWVGTGSLPPPQRWPLPHCRPPGPPFNLVVEPCGFPAEPGPGLLPRGRGSPVPARPPPAPQVVQGREEPRPAPRGSSQRRPQAGALGAWAGSRVRAPRGSVGAGGEICHTSACCWQPSWTRLLLLITWMLLITLSANLFTVPERSLTTTFSFSRYKSSDRPAHKVSMLLLCHALAIAVVQIVIFSESWAFAKNINFYNVRPPLDHK

SEQ ID NO: 892708 - protein, 169 aa, Homo sapiens [sequence omitted]

SEQ ID NO: 892709 - protein, 497 aa, Homo sapiens
MEGSGEQPGPQPQHPGDHRIRDGDFVVLKREDVFKAVQVQRRKKVTFEKQWFYLDNVIGHSYGTAFEVTSGGSLQPKKKREEPTAETKEAGTDNRNIVDDGKSQKLTQDDIKALKDKGIKGEEIVQQLIENSTTFRDKTEFAQDKYIKKKKKKYEAIITVVKPSTRILSIMYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGLIVASRFHPTPLLLSLLDFVAPSRPFVVYCQYKEPLLECYTKLRERGGVINLRLSETWLRNYQVLPDRSHPKLLMSGGGGYLLSGFTVAMDNLKADTSLKSNASTLESHETEEPAAKKRKCPESDS

SEQ ID NO: 892710 - protein, 327 aa, Homo sapiens
MYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGLIVASRFHPTPLLLSLLDFVAPSRPFVVYCQYKEPLLECYTKLRERGGVINLRLSETWLRNYQVLPDRSHPKLLMSGGGGYLLSGFTVAMDNLKADTSLKSNASTLESHETEEPAAKKRKCPESDS

SEQ ID NO: 892711 - protein, 400 aa, Homo sapiens
MEGSGEQPGPQPQHPGDHRIRDGDFVVLKREDVFKAVQVQRRKKVTFEKQWFYLDNVIGHSYGTAFEVTSGGSLQPKKKREEPTAETKEAGTDNRNIVDDGKSQKLTQDDIKALKDKGIKGEEIVQQLIENSTTFRDKTEFAQDKYIKKKKKKYEAIITVVKPSTRILSIMYYAREPGKINHMRYDTLAQMLTLGNIRAGNKMIVMETCAGLVLGAMMERMGGFGSIIQLYPGGGPVRAATACFGFPKSFLSGLYEFPLNKVDSLLHGTFSAKMLSSEPKDSALVEESNGTLEEKQASEQENEDSMAEAPESNHPEDQETMETISQDPEHKGPKERGSKKDYIQEKQRRQEEQRKRHLEAAALLSERNADGCVDGRRQETPQCMWALLQTDWHSLSPCLL

SEQ ID NO: 892712 - protein, 239 aa, Homo sapiens
LHPGTDSSRLDAGTMVMAEGTAVLRRNRPGTKAQDFYNWPDESFDEMDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 892713 - protein, 239 aa, Homo sapiens; identical to SEQ ID NO: 892712

SEQ ID NO: 892714 - protein, 193 aa, Homo sapiens
MDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 892715 - protein, 239 aa, Homo sapiens; identical to SEQ ID NO: 892712

SEQ ID NO: 892716 - protein, 239 aa, Homo sapiens; identical to SEQ ID NO: 892712

SEQ ID NO: 892717 - protein, 239 aa, Homo sapiens; identical to SEQ ID NO: 892712

SEQ ID NO: 892718 - protein, 218 aa, Homo sapiens
LHPGTDSSRLDAGTMVMAEGTAVLRRNRPGTKAQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 892719 - protein, 193 aa, Homo sapiens; identical to SEQ ID NO: 892714

SEQ ID NO: 892720 - protein, 126 aa, Homo sapiens
MTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 892721 - protein, 168 aa, Homo sapiens
FGGPFGVSPQKKKPLFFPKGERVGKNGPPQSQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 892722 - protein, 575 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 892723 - protein, 575 aa, Homo sapiens; identical to SEQ ID NO: 892722

SEQ ID NO: 892724 - protein, 642 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 892725 - protein, 575 aa, Homo sapiens; identical to SEQ ID NO: 892722

SEQ ID NO: 892726 - protein, 161 aa, Homo sapiens
MKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 892727 - protein, 575 aa, Homo sapiens; identical to SEQ ID NO: 892722

SEQ ID NO: 892728 - protein, 546 aa, Homo sapiens [sequence omitted]

SEQ ID NO: 892729 - protein, 642 aa, Homo sapiens; identical to SEQ ID NO: 892724

SEQ ID NO: 892730 - protein, 642 aa, Homo sapiens; identical to SEQ ID NO: 892724

SEQ ID NO: 892731 - protein, 713 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVADNSSSVESLNMKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 892732 - protein, 575 aa, Homo sapiens; identical to SEQ ID NO: 892722

SEQ ID NO: 892733 - protein, 433 aa, Homo sapiens
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLTEPIERKRLAVLKRR

SEQ ID NO: 892734 - protein, 77 aa, Homo sapiens
KRERVRRQRGGKQRLSFENFFNWGAEAAFGLQLFPLHFHRGRILRSQPSLFPQSPVPCLTSFPSGPRLPRPKPSLPL

SEQ ID NO: 892735 - protein, 275 aa, Homo sapiens
MESYSVTQAGVQWHELCSLQPSPPRFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 892736 - protein, 275 aa, Homo sapiens; identical to SEQ ID NO: 892735

SEQ ID NO: 892737 - protein, 347 aa, Homo sapiens
SALETLNSPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 892738 - protein, 162 aa, Homo sapiens
MFVFWFVGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 892739 - protein, 274 aa, Homo sapiens
MESYSVTQAGVQWHELCSLQPSPPRFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSNY

SEQ ID NO: 892740 - protein, 69 aa, Homo sapiens
CSGAEQSARGAAQQLLLASVDASRLVRASRARAVHRQSAAAQEREGLSRLRCFFKTDPGNASFSKGCCC

SEQ ID NO: 892741 - protein, 159 aa, Homo sapiens
MTLEEVRGQDTVPESTARMQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 892742 - protein, 141 aa, Homo sapiens
MQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 892743 - protein, 861 aa, Homo sapiens
MAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKRDAKEAKAQNEATSTPHRIRRKSSVLTMNRIRQQLRFLGNSKSDQEEKEILPAAEISDSSSDEEEASTPPLPRRAPRTVSRNLRSSLKSSLHTLTKVPKKSLKPRTPRCAAPQIRSRSLAAQEPASVLEEARLRLHVSAVPESLPCREQEFQDIYNFVESKLLDHTGGCMYISGVPGTGKTATVHEVIRCLQQAAQANDVPPFQYIEVNGMKLTEPHQVYVQILQKLTGQKATANHAAELLAKQFCTRGSPQETTVLLVDELDLLWTHKQDIMYNLFDWPTHKEARLVVLAIANTMDLPERIMMNRVSSRLGLTRMCFQPYTYSQLQQILRSRLKHLKAFEDDAIQLVARKVAALSGDARRCLDICRRATEICEFSQQKPDSPGLVTIAHSMEAVDEMFSSSYITAIKNSSVLEQSFLRAILAEFRRSGLEEATFQQIYSQHVALCRMEGLPYPTMSETMAVCSHLGSCRLLLVEPSRNDLLLRVRLNVSQDDVLYALKDE

SEQ ID NO: 892744 - protein, 861 aa, Homo sapiens; identical to SEQ ID NO: 892743

SEQ ID NO: 892745 - protein, 361 aa, Homo sapiens
MAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKR

SEQ ID NO: 892746 - protein, 724 aa, Homo sapiens
MAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKRDAKEAKAQNEATSTPHRIRRKSSVLTMNRIRQQLRFLGNSKSDQEEKEILPAAEISDSSSDEEEASTPPLPRRAPRTVSRNLRSSLKSSLHTLTKVPKKSLKPRTPRCAAPQIRSRSLAAQEPASVLEEARLRLHVSAVPESLPCREQEFQDIYNFVESKLLDHTGGCMYISGVPGTGKTATVHEVIRCLQQAAQANDVPPFQYIEVNGMKLTEPHQVYVQILQKLTGQKATANHAAELLAKQFCTRGSPQETTVLLVDELDLLWTHKQDIMYNLFDWPTHKEARLVVLAIANTMDLPERIMMNRVSSRLGLTRMCFQPYTYSQLQQILRSRLKHLKAFEDDAIQLVARKAGVQWHDHGSLQP

SEQ ID NO: 892747 - protein, 727 aa, Homo sapiens
AREIPSASGIRRVSKTMATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 892748 - protein, 707 aa, Homo sapiens
AREIPSASGIRRVSKTMATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEISILLKPFLQCPTTHKI

SEQ ID NO: 892749 - protein, 513 aa, Homo sapiens [sequence omitted]

SEQ ID NO: 892750 - protein, 250 aa, Homo sapiens [sequence omitted]

SEQ ID NO: 892751 - protein, 254 aa, Homo sapiens
AREIPSASGIRRVSKTMATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISR

SEQ ID NO: 892752 - protein, 727 aa, Homo sapiens; identical to SEQ ID NO: 892747

SEQ ID NO: 892753 - protein, 658 aa, Homo sapiens
MKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 892754 - protein, 484 aa, Homo sapiens
MESFATKVLQDNDNRRRLPLARSSPVVVILKDMESFATKVLQDFIIISSQHLHEFPLILIFGIATSPIIIHRLLPHAVSSLLCIELFQSLSCKEHLTTVLDKLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 892755 - protein, 363 aa, Homo sapiens
AREIPSASGIRRVSKTMATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFIKFSTEEIMTHAFAHASGQTPSPRLALSTRYSPDEMNNSPNFEEKKK

SEQ ID NO: 892756 - protein, 580 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 892757 - protein, 116 aa, Homo sapiens
MSWDCGFKYIFAFSPTLKAGVMCKLQERDEIGRIELVQKLAKENYQFLQTDKKEQEKSEHVSLLPLGDAGLKGWKMFLPDCMFEPPRASSLVKMTAAHSSKQVAYDTGFIRDSSQK

SEQ ID NO: 892758 - protein, 116 aa, Homo sapiens; identical to SEQ ID NO: 892757

SEQ ID NO: 892759 - protein, 580 aa, Homo sapiens; identical to SEQ ID NO: 892756

SEQ ID NO: 892760 - protein, 649 aa, Homo sapiens
MSWDCGFKYIFAFSPTLKAGVMCKLQERDEIGRIELVQKLAKENYQFLQTDKKEQEKSEHQDDEVTTVQVKEQDQSVLVLKKVQCCGPAPTAGSAESHWRYVVVSGTPEKILEHLLNDLHLEEVQDKETVIPTPGITCVTSAMCSKAKRTRTSWLDSPSTNLSGEEEETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 892761 - protein, 611 aa, Homo sapiens [sequence omitted]

SEQ ID NO: 892762 - protein, 468 aa, Homo sapiens
MTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 892763 - protein, 358 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLVRTFSLVFETNRPGEVAHTCNLSTLGGQGRKMA

SEQ ID NO: 892764 - protein, 463 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEVSLGVPW

SEQ ID NO: 892765 - protein, 595 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFEEDKIWQIIIPSWQQVYAVKSDFTHSETSSPQLPLTPVPTVSCFACPLAQNHW

SEQ ID NO: 892766 - protein, 544 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGE

SEQ ID NO: 892767 - protein, 411 aa, Homo sapiens
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTRGDAGEEEEKREKWCHMTQEERDDSLRFNENITFGQLGTFTHNMLAFGLNKKLCNDFLKKQAVIGNLDEEQYKLLSDHIEQMATE

SEQ ID NO: 892768 - protein, 401 aa, Homo sapiens
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTREKWCHMTQEERDDSLRFNENITFGQLGTFTHNMLAFGLNKKLCNDFLKKQAVIGNLDEEQYKLLSDHIEQMATE

SEQ ID NO: 892769 - protein, 301 aa, Homo sapiens
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIW

SEQ ID NO: 892770 - protein, 197 aa, Homo sapiens
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKTWVG

SEQ ID NO: 892771 - protein, 591 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892772 - protein, 652 aa, Homo sapiens
WWAVRGESPGCSLGIQHGGGSVRGGGGARELREARGRGVPGRAVRPRATAAPSRPHRVPGTMFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892773 - protein, 591 aa, Homo sapiens; identical to SEQ ID NO: 892771

SEQ ID NO: 892774 - protein, 426 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892775 - protein, 381 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEM

SEQ ID NO: 892776 - protein, 384 aa, Homo sapiens
MGCQRSRPPRPEGAGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892777 - protein, 591 aa, Homo sapiens; identical to SEQ ID NO: 892771

SEQ ID NO: 892778 - protein, 215 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGSLRTSPLGPVRALLWSAWGTGGGLTTGCALRSPLAGRSLPERPLGVL

SEQ ID NO: 892779 - protein, 591 aa, Homo sapiens; identical to SEQ ID NO: 892771

SEQ ID NO: 892780 - protein, 438 aa, Homo sapiens
MFGKRKKRVEISAPSNFEHRVHTGFDQHEQKFTGLPRQWQSLIEESARRPKPLVDPACITSIQPGAPKGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892781 - protein, 591 aa, Homo sapiens; identical to SEQ ID NO: 892771

SEQ ID NO: 892782 - protein, 525 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGLGRNWQLAGPLTPTRGLTRTTHPGVPRGSLMTWPLTGHQRGAWPSPSPPPPPPGLPPEPEVPPALECWDPTPQSPSWPLQPAPPPPLLFLGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892783 - protein, 499 aa, Homo sapiens
WWAVRGESPGCSLGIQHGGGSVRGGGGARELREARGRGVPGRAVRPRATAAPSRPHRVPGTMFGKRKKRVEISAPSNFEHRVHTGFDQHEQKFTGLPRQWQSLIEESARRPKPLVDPACITSIQPGAPKGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 892784 - protein, 106 aa, Homo sapiens
HTSSGLHTSSGLHTSSGLHTSSGLHTSSGLHTNSGLHTSSGLHTSSGLHTSSGVPLWGSIMNVRRVAFSRSPAPPFCGWMGRQVRAPHPLQPLQQMTTAPGQPPLF

SEQ ID NO: 892785 - protein, 327 aa, Homo sapiens
MASMAAAIAASRSAVMSGNRPLDDRERKRFTYFSSLSPMARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 892786 - protein, 327 aa, Homo sapiens; identical to SEQ ID NO: 892785

SEQ ID NO: 892787 - protein, 85 aa, Homo sapiens
RGANLPYRELLHIKAVLVHMAPLNAFELCTKRFCPASNPGRGHFQSAHNAVCTWSPLIFRQPAPERVVVPKPKVGFCVFFFFFFF

SEQ ID NO: 892788 - protein, 327 aa, Homo sapiens; identical to SEQ ID NO: 892785

SEQ ID NO: 892789 - protein, 327 aa, Homo sapiens; identical to SEQ ID NO: 892785

SEQ ID NO: 892790 - protein, 327 aa, Homo sapiens; identical to SEQ ID NO: 892785

SEQ ID NO: 892791 - protein, 327 aa, Homo sapiens; identical to SEQ ID NO: 892785

SEQ ID NO: 892792 - protein, 327 aa, Homo sapiens; identical to SEQ ID NO: 892785

SEQ ID NO: 892793 - protein, 327 aa, Homo sapiens; identical to SEQ ID NO: 892785

SEQ ID NO: 892794 - protein, 428 aa, Homo sapiens
MASMAAAIAASRSAVMSGNRPLDDRERKRFTYFSSLSPMARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSGLYQRVLRWDGALFHGNREGPPQSRQATGAHALFLLLPLPLPQRMPRLRVLSHQQICNKTSFASPSGCPNLFTSQGSVAHCAFPSARAAIRRGPWKALRPGLSQLKAVLGLLFGSCP

SEQ ID NO: 892795 - protein, 302 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 892796 - protein, 302 aa, Homo sapiens; identical to SEQ ID NO: 892795

SEQ ID NO: 892797 - protein, 302 aa, Homo sapiens; identical to SEQ ID NO: 892795

SEQ ID NO: 892798 - protein, 302 aa, Homo sapiens; identical to SEQ ID NO: 892795

SEQ ID NO: 892799 - protein, 302 aa, Homo sapiens; identical to SEQ ID NO: 892795

SEQ ID NO: 892800 - protein, 274 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGVLGAKLKFSFLCGALRFRALGEGGGRSVISMCNF

SEQ ID NO: 892801 - protein, 220 aa, Homo sapiens
GDAGHHLPEPSSRETGRGAKGERGSKSHPNALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 892802 - protein, 160 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKPLQGPPRGSRTSPPRAQQ

SEQ ID NO: 892803 - protein, 302 aa, Homo sapiens; identical to SEQ ID NO: 892795

SEQ ID NO: 892804 - protein, 274 aa, Homo sapiens; identical to SEQ ID NO: 892800

SEQ ID NO: 892805 - protein, 909 aa, Homo sapiens
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 892806 - protein, 909 aa, Homo sapiens; identical to SEQ ID NO: 892805

SEQ ID NO: 892807 - protein, 937 aa, Homo sapiens
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDASGGSTLLNLDFFGPVDDSSSSSSTTIPGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 892808 - protein, 891 aa, Homo sapiens
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVNFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 892809 - protein, 151 aa, Homo sapiens [sequence omitted]

SEQ ID NO: 892810 - protein, 806 aa, Homo sapiens
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQVWIRSCMS

SEQ ID NO: 892811 - protein, 153 aa, Homo sapiens
LHVQVCVLPLFTHNPSSLGLPSVWLPTNTVTEFQASGGSTLLNLDFFGPVDDSSSSSSTTIPGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 892812 - protein, 85 aa, Homo sapiens
VKAVFRKGNWVCHTISDLLKAMRNYTCPQGTHSSQGVSDPKTDYTLPTQKRPLHWYDPETSTEPGFDGRSSPKLHPLPPPSHPST

SEQ ID NO: 892813 - protein, 635 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPRILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKSVTYEPDFNSAELLAKELYRVFQKCWILSVVNSQLAGSLSAAGSIVVNEECVRKDFESSMNVVQEIKFKSRIRGTEDWAPPRFQIIFNIHPPLKRDLVVAAQNFFCAGCGTPVEPKFVKRLRYCEYLGKYFCDCCHSYAESCIPARILMMWDFKKYYVSNFSKQLLDSIWHQPIFNLLSIGQSLYAKAKELDRVKEIQEQLFHIKKLLKTCRFANSCVKERALFVNFARIRLSSSHFRQQHVEDVQRAGLAFTNSASSPPSAPGVRGSQRGENFWKVWPLQQHDAPEYCEKDCSTCLMITPICVYYW

SEQ ID NO: 892814 - protein, 635 aa, Homo sapiens; identical to SEQ ID NO: 892813

SEQ ID NO: 892815 - protein, 662 aa, Homo sapiens [sequence omitted]

SEQ ID NO: 892816 - protein, 662 aa, Homo sapiens [sequence omitted]

SEQ ID NO: 892817 - protein, 595 aa, Homo sapiens [sequence omitted]

SEQ ID NO: 892818 - protein, 662 aa, Homo sapiens [sequence omitted]

SEQ ID NO: 892819 - protein, 527 aa, Homo sapiens [sequence omitted]

SEQ ID NO: 892820 - protein, 146 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVKACMRKPRSWTE

SEQ ID NO: 892821 - protein, 345 aa, Homo sapiens
MVSQSTVRQDSPVEPWEGISDHSGIIDGSPRLLNTDHPPCQLDIRLMRHKAVWINPQDVQQQPQDLQSQVPAAGNSGTHFVTDAASPSGPSPSCLGDSLAETTLSEDTTDSVGSASPHGSSEKSSSFSLSSTEVHMVRPGYSHRVSLPTSPRILATSPYPETDSAFFEPSHLTSAADEGAVQVSRRTISSNSFSPEVFVLPVDVEKENAHFYVADMIISAMEKMKCNILSQQQTESWSKEVSGLLGSDQPDSEMTFDTNIKQESGSSTSSYSGYEGCAVLQVSPVTETRTYHDVKEICKCDVDEFVILELGDFNDITETCSCSCSSSKRYLSSVHSAHRPLGCHL

SEQ ID NO: 892822 - protein, 662 aa, Homo sapiens [sequence omitted]

SEQ ID NO: 892823 - protein, 662 aa, Homo sapiens [sequence omitted]

SEQ ID NO: 892824 - protein, 662 aa, Homo sapiens [sequence omitted]

SEQ ID NO: 892825 - protein, 527 aa, Homo sapiens [sequence omitted]

SEQ ID NO: 892826 - protein, 185 aa, Homo sapiens [sequence omitted]

SEQ ID NO: 892827 - protein, 183 aa, Homo sapiens [sequence omitted]

SEQ ID NO: 892828 - protein, 134 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPIEEGGQTEAREPPQASSWEGPSTTRRRSQLWHGCPGCGRGGFTLCP

SEQ ID NO: 892829 - protein, 677 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892830 - protein, 473 aa, Homo sapiens
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892831 - protein, 617 aa, Homo sapiens
ARAARCAEVAVEGGSRRWQAAAPRPAVPCAGACARSSVSDLLVRNAGGPACLAICIPESASGRGLWDGRWASSFVQMLRDLACYGRQQPALAESAVHSALRALQGQALLFPGIFLEEIGTEDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892832 - protein, 454 aa, Homo sapiens
MDSAFRTIRNVCLIQGHKVFLLRFCLKCLYFNSPPRSVICFELTSACSARCGLGGGSRFPFWPPWNRPRGGGGGGGGGGGGGGGGGGHRALTAVLWVTWQLGSMFFVTKAGTLALCLVNRWIVYTYGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892833 - protein, 373 aa, Homo sapiens
MFFVTKAGTLALCLVNRWIVYTYGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRRDLSMPRCAKAKSQPHFPVLAQYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892834 - protein, 213 aa, Homo sapiens
GLSPHPRPRSPLENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892835 - protein, 107 aa, Homo sapiens
KIASRAACYRRGTCWTVVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 892836 - protein, 677 aa, Homo sapiens; identical to SEQ ID NO: 892829

SEQ ID NO: 892837 - protein, 674 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNACVLRRGWP

SEQ ID NO: 892838 - protein, 572 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPAPTWPAAGQTPLPPPRAQ

SEQ ID NO: 892839 - protein, 208 aa, Homo sapiens
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVDSLRPASFPTWGCDLGVVTRVVTGVYPRCLHASQWPVCAACPVRKFWSVG

SEQ ID NO: 892840 - protein, 341 aa, Homo sapiens
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGLRRGGGVPQCQGGTRLSWDPAPTPAS

SEQ ID NO: 892841 - protein, 341 aa, Homo sapiens
LPGVPTSRSSHPKEWGHWQLLNQLGTGWRGWVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGLRRGGGVPQCQGGTRLSWDPAPTPAS

SEQ ID NO: 892842 - protein, 246 aa, Homo sapiens
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGAPSSRHGTSSTIPSASCAVTAA

SEQ ID NO: 892843 - protein, 341 aa, Homo sapiens; identical to SEQ ID NO: 892840

SEQ ID NO: 892844 - protein, 341 aa, Homo sapiens; identical to SEQ ID NO: 892840

SEQ ID NO: 892845 - protein, 263 aa, Homo sapiens
MPHSVTLRGPSPWGFRLVGGRDFSAPLTISRDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGLRRGGGVPQCQGGTRLSWDPAPTPAS

SEQ ID NO: 892846 - protein, 341 aa, Homo sapiens; identical to SEQ ID NO: 892840

SEQ ID NO: 892847 - protein, 183 aa, Homo sapiens
MSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGLRRGGGVPQCQGGTRLSWDPAPTPAS

SEQ ID NO: 892848 - protein, 449 aa, Homo sapiens
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGEDACHLSPSAFPLPAVPRLPPSDPTSRLAVTCPLRSLRPGPTPLLQPCYALASRFPLHPLSLPLTHARQTRSPVSGADGPSGAQPNTPQKWSSDLLTPFMPPTLRVSGDWPGPGGPRNLKPTASKLGAPLSGLQGLPECTRCGHGIVGTIVKARDKLYHPECFMCSDCGLNLKQRGYFFLDERLYCESHAKARVKPPEGLRRGGGVPQCQGGTRLSWDPAPTPAS

SEQ ID NO: 892849 - protein, 310 aa, Homo sapiens
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGADGRLGAGTSHGKKRGPVKAQGAKSPCAGRGHVGGKLHQGGRMGKHRGLATVSKPGDARTGAHRGSAPGKGERKNGAQHSGCGGGWG

SEQ ID NO: 892850 - protein, 272 aa, Homo sapiens
PPPRLLRLGTRLRGVNRPRWRSVSPCRQLHFPLFLFPFPSRPRAPPSLVGWSRSPCAFSLLGSCVRACPAMNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQRL

SEQ ID NO: 892851 - protein, 100 aa, Homo sapiens
YHLFLDIYVCMISFAHNVAAQGKYIAIVSTTVETKEPEKEIRPALELLEPIEQKFVSISDLLVPKDLGTESQIFISRTYDATTHFETTCDDIKNIFWWQG

SEQ ID NO: 892852 - protein, 445 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892853 - protein, 445 aa, Homo sapiens; identical to SEQ ID NO: 892852

SEQ ID NO: 892854 - protein, 445 aa, Homo sapiens; identical to SEQ ID NO: 892852

SEQ ID NO: 892855 - protein, 445 aa, Homo sapiens; identical to SEQ ID NO: 892852

SEQ ID NO: 892856 - protein, 445 aa, Homo sapiens; identical to SEQ ID NO: 892852

SEQ ID NO: 892857 - protein, 445 aa, Homo sapiens; identical to SEQ ID NO: 892852

SEQ ID NO: 892858 - protein, 445 aa, Homo sapiens; identical to SEQ ID NO: 892852

SEQ ID NO: 892859 - protein, 445 aa, Homo sapiens; identical to SEQ ID NO: 892852

SEQ ID NO: 892860 - protein, 445 aa, Homo sapiens; identical to SEQ ID NO: 892852

SEQ ID NO: 892861 - protein, 423 aa, Homo sapiens
MSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892862 - protein, 375 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDLLASVTSWYQKTWEQKARSLFPAHMMPPLILRQRVMTLKTSIRG

SEQ ID NO: 892863 - protein, 427 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNKNDIYGED

SEQ ID NO: 892864 - protein, 495 aa, Homo sapiens
SPRKPPQKLLPVLCDLYSLQNQRSMVQYNISSSSIYGVTSQNNTFRVSLGKRKPSNFYLANFLGKECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892865 - protein, 196 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDE

SEQ ID NO: 892866 - protein, 410 aa, Homo sapiens
MYPVRYNVSEWQESSSYGSKPLLRRRECIYNTIGRYWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892867 - protein, 400 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892868 - protein, 445 aa, Homo sapiens; identical to SEQ ID NO: 892852

SEQ ID NO: 892869 - protein, 445 aa, Homo sapiens; identical to SEQ ID NO: 892852

SEQ ID NO: 892870 - protein, 314 aa, Homo sapiens [sequence omitted]

SEQ ID NO: 892871 - protein, 266 aa, Homo sapiens
ALEDPERVMGALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892872 - protein, 403 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFIPRR

SEQ ID NO: 892873 - protein, 414 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIYFPHIMSHVGGILLER

SEQ ID NO: 892874 - protein, 371 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKELYLIRPVSGL

SEQ ID NO: 892875 - protein, 404 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKERGKPEKGNQKTPQAFGGPLSFGKNQKTLEKPKGGEKPNFLGGY

SEQ ID NO: 892876 - protein, 198 aa, Homo sapiens
ERAYTRRRHLTGSYMMAEVGKTFKQKQYKQRSKEKQETWHIENHKKFGMADVSKLRHLAPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 892877 - protein, 333 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSGEV

SEQ ID NO: 892878 - protein, 277 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEVSSF

SEQ ID NO: 892879 - protein, 240 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFAR

SEQ ID NO: 892880 - protein, 202 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDSLDHRV

SEQ ID NO: 892881 - protein, 196 aa, Homo sapiens; identical to SEQ ID NO: 892865

SEQ ID NO: 892882 - protein, 202 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQRL

SEQ ID NO: 892883 - protein, 239 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALAQPHCRGLGNTIGAPAEGHSPLKAVTRAKVLGGADAPMDLAHPAQPQASS

SEQ ID NO: 892884 - protein, 254 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALDNCDAETDRFTMRMQARCFTESPVKIRKFRDPFEQVGNSFWDTSTYLGLHTKDPPSLNPLIFKIP

SEQ ID NO: 892885 - protein, 130 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALAST

SEQ ID NO: 892886 - protein, 128 aa, Homo sapiens
MEVLCWKCFGRSSVGGLWKGVYIGVSAGGRGLHVNRFCTEITRERGWEDGKRRFPVCTPENMGEGPVPWPVRRRSGCGNSRPGGSGGGRSRPGNALYAQAGPWEPQSHGSCPGWCRSWTWGNWRAWPG

SEQ ID NO: 892887 - protein, 329 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVGE

SEQ ID NO: 892888 - protein, 329 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVAW

SEQ ID NO: 892889 - protein, 72 aa, Homo sapiens
GNSPAGRPIGFWVCYPKNDKVGFISRSRSKRKPQRSRAQLTGKGVRSLEFESYPELQDRGGFQLPARPDLPS

SEQ ID NO: 892890 - protein, 72 aa, Homo sapiens; identical to SEQ ID NO: 892889

SEQ ID NO: 892891 - protein, 329 aa, Homo sapiens; identical to SEQ ID NO: 892887

SEQ ID NO: 892892 - protein, 100 aa, Homo sapiens
DFALSPWNPRMVSSLYLPASAGVRHRPSTQSLLRELAATVIIIVTNDGEQTNSRKATSLRVSLCSGTFCHDGNDSHLHCPVQQPLATGAKHSGEASATRT

SEQ ID NO: 892893 - protein, 72 aa, Homo sapiens; identical to SEQ ID NO: 892889

SEQ ID NO: 892894 - protein, 72 aa, Homo sapiens; identical to SEQ ID NO: 892889

SEQ ID NO: 892895 - protein, 72 aa, Homo sapiens; identical to SEQ ID NO: 892889

SEQ ID NO: 892896 - protein, 329 aa, Homo sapiens; identical to SEQ ID NO: 892887

SEQ ID NO: 892897 - protein, 72 aa, Homo sapiens; identical to SEQ ID NO: 892889

SEQ ID NO: 892898 - protein, 465 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVATSNHPETDYKNKDWVFINYTYKRFEGLTARGAIPSYMKAAK

SEQ ID NO: 892899 - protein, 124 aa, Homo sapiens
LILADREDISENWYSLVCCVCVCVCVCVCVWWLCIFLFPGDMMTLLMKKDTLTEEETQFYIAETVLAIDSIHQLGFIHRDIKPDNLLLDSKVLGGHWHELCTFTDLSSLCFNTCTPVVIPVGEL

SEQ ID NO: 892900 - protein, 465 aa, Homo sapiens; identical to SEQ ID NO: 892898

SEQ ID NO: 892901 - protein, 428 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVLSSAP

SEQ ID NO: 892902 - protein, 465 aa, Homo sapiens; identical to SEQ ID NO: 892898

SEQ ID NO: 892903 - protein, 439 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTDAFLGDTPPHPKGSPAT

SEQ ID NO: 892904 - protein, 336 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGKLHGFRGLFLCIHDRLLH

SEQ ID NO: 892905 - protein, 256 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKVLGGHWHELCTFTDLSSLCFNTCTPVVIPVGEL

SEQ ID NO: 892906 - protein, 92 aa, Homo sapiens
ISLRFAHTPCGQEELEFAIMRIEALKLARQIALASRSHQDAKVPVCCCVRHLLRMSCVPLGSRSCFANHPPGGHHRCPAKSRFQKAESVTLA

SEQ ID NO: 892907 - protein, 973 aa, Homo sapiens
MPPELSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892908 - protein, 291 aa, Homo sapiens
KQHQETSACGSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAVLRVMSPS

SEQ ID NO: 892909 - protein, 216 aa, Homo sapiens
KQHQETSACGSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDQASVPDQASVPD

SEQ ID NO: 892910 - protein, 1229 aa, Homo sapiens
KQHQETSACGSPHGEDGPGDFAHTGVPGHVPRSTCAPSPQREVLTVPEANSEPWTLDTLGGERRPGVTTGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892911 - protein, 1019 aa, Homo sapiens
MRLRTKAAPCGPSPISPGGSPVADDIIQPAAPADLESPTLAASSYHGDVVGQVSTDLIAQRSSDSEEAFETPESTTPVKAPPAPPPPPPEVIPEPEVSTQPPPEEPVETGFHHDDQAGLKLLTSSDLPASASQSAGITGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892912 - protein, 1276 aa, Homo sapiens
KQHQETSACGSPHGEDGPGDFAHTGVPGHVPRSTCAPSPQREVLTVPEANSEPWTLDTLGGERRPGVTTGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892913 - protein, 1157 aa, Homo sapiens
KQHQETSACGSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892914 - protein, 97 aa, Homo sapiens
CIWQGQGHNSIGSFFYFDVVHLPSRYPAPCPLPYTTPWPCHMQAYGKAKQEQAAHQASLRKEQLRVDALERTLEQKNKEIEELTKICDELIAKMGKS

SEQ ID NO: 892915 - protein, 1133 aa, Homo sapiens
KQHQETSACGSPHGEDGPGDFAHTGVPGHVPRSTCAPSPQREVLTVPEANSEPWTLDTLGGERRPGVTTGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKN

SEQ ID NO: 892916 - protein, 1117 aa, Homo sapiens
KQHQETSACGSPHGEDGPGDFAHTGVPGHVPRSTCAPSPQREVLTVPEANSEPWTLDTLGGERRPGVTAGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKVPVCCCVRHLLRMSCVPLGSRSCFANHPPGGHHRCPAKSRFQKAESVTLA

SEQ ID NO: 892917 - protein, 189 aa, Homo sapiens
GFKRRAFRTTPALTLIPARPGQSRARRPHSGARRPHSRAHIRGARPPAPGSGRESQLPAAAPAATDARSCSPLQCSNPGRRRPPRLPAAGIAPGRWPRSRLACTPGHSEDGRVAVPAASPSQRPEPGGFRGNVSAPPGPPRVSRGGGEDARALLVSPFLMPVQPGAQAGLGFFAALESFTWGCSGRSIW

SEQ ID NO: 892918 - protein, 1026 aa, Homo sapiens
MGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892919 - protein, 906 aa, Homo sapiens
MFWYKRRGAPMRPVSVIDGVVCVSPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892920 - protein, 101 aa, Homo sapiens
CCLLSSWWLQNNEGFSLMGYLFSVEECSSFHLRCTFRPTVPKLICDFDPCSRTTMPRRSRPCTLCLTLLRRALSSHLPSACQSPRRRVQGQVLKREQPAIL

SEQ ID NO: 892921 - protein, 1031 aa, Homo sapiens
FSIGHEEKCLTIYIILLIAFFYYPRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892922 - protein, 950 aa, Homo sapiens
SAPAGDRVEASTPSCPDPAKDLSRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAKQEQAAHQASLRKEQLRVDALERTLEQKNKEIEELTKICDELIAKMGKS

SEQ ID NO: 892923 - protein, 1229 aa, Homo sapiens; identical to SEQ ID NO: 892910

SEQ ID NO: 892924 - protein, 1229 aa, Homo sapiens; identical to SEQ ID NO: 892910

SEQ ID NO: 892925 - protein, 1110 aa, Homo sapiens
KQHQETSACGSPHGEDGPGDFAHTGVPGHVPRSTCAPSPQREVLTVPEANSEPWTLDTLGGERRPGVTTGILEMRNALGNQSTPAPPTGEVADTPLEPGKVAGAAGKAEGDITLSTAETQACASGDLPEAGTTRTFSVVAGDLVLPGSCQDPACSDKAPGMEGTAALHGDSPARPQQAKEQPGPERPIPAGDGKVCVSSPPEPDETHDPKLQHLAPEELHTDRESPRPGPSMLPSVPKKDAPRVMDKVTSDETRGAEGTESSPVADDIIQPAAPADLESPTLAASSYHGDVVGQVSTDLIAQRSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIGTAEVEKPAGLLFQQPDLDSALQIARAEIITKEREVSEWKDKYEESRREVMEMRKIVAEYEKTIAQMIGRCPDLRGLRPAPMFLNYEEALEDRRLRVGFW

SEQ ID NO: 892926 - protein, 201 aa, Homo sapiens
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGCVAQGCQHWLRIQSKRP

SEQ ID NO: 892927 - protein, 321 aa, Homo sapiens
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSEIAPQHSNLGDRVSETLSKKKKKERREGGRKEGRKERKKGQLWPRCGYPLVSCLYVFLLFLFCHLPHLSLRPVSSSCGHCHPLW

SEQ ID NO: 892928 - protein, 321 aa, Homo sapiens; identical to SEQ ID NO: 892927

SEQ ID NO: 892929 - protein, 444 aa, Homo sapiens
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQHVFCEECLCLWLDRERTCPLCRSVAVDTLRCWKDGATSAHFQVY

SEQ ID NO: 892930 - protein, 321 aa, Homo sapiens; identical to SEQ ID NO: 892927

SEQ ID NO: 892931 - protein, 330 aa, Homo sapiens
MPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQMLLKGHKKLELEKIDESAGV

SEQ ID NO: 892932 - protein, 330 aa, Homo sapiens; identical to SEQ ID NO: 892931

SEQ ID NO: 892933 - protein, 307 aa, Homo sapiens
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKVGTGCGHKVAYQF

SEQ ID NO: 892934 - protein, 379 aa, Homo sapiens
MTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 892935 - protein, 342 aa, Homo sapiens
MTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 892936 - protein, 473 aa, Homo sapiens
MTVTRTHHFKEGSLRAPAIPLHSAAAELASNHPRGPEANLEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 892937 - protein, 379 aa, Homo sapiens; identical to SEQ ID NO: 892934

SEQ ID NO: 892938 - protein, 121 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQG

SEQ ID NO: 892939 - protein, 636 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKLRFPCRITESKNMNILIVLDMLCYISSEKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSDPETP

SEQ ID NO: 892940 - protein, 460 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892941 - protein, 365 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQNMIRADFEAVGRIFCLGMG

SEQ ID NO: 892942 - protein, 294 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKD

SEQ ID NO: 892943 - protein, 662 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQNMSEQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892944 - protein, 531 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQNMSEQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892945 - protein, 551 aa, Homo sapiens
ILPVIVICMLLGFIKLANIIQVVKFLILILYLLKNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQNMSEQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892946 - protein, 441 aa, Homo sapiens
ILPVIVICMLLGFIKLANIIQVVKFLILILYLLKNLKKKVFEKEAHIQELSCLFQSEKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892947 - protein, 110 aa, Homo sapiens
AAVAREATSRLLAALLFHLSGHSSAASRSRNSPGSHLASLAFLPSLPTVVPPASRSLLADSEHKKDCHGFHCSSRGASDPFFISRRRRAVVTTTCGRSGGGLSAYVEKSL

SEQ ID NO: 892948 - protein, 531 aa, Homo sapiens; identical to SEQ ID NO: 892944

SEQ ID NO: 892949 - protein, 355 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVSSRPSEFC

SEQ ID NO: 892950 - protein, 600 aa, Homo sapiens
AAVAREATSRLLAALLFHLSGHSSAASRSRNSPGSHLASLAFLPSLPTVVPPASRSLLADSEHKKDCHGFHCSSRGASDPFFISRRRRAVVTTTCGRSGGGTGDNLSSMLLENLTDNESENTNLKKKVFEKEAHIQELSCLFQSEKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQNMSEQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892951 - protein, 681 aa, Homo sapiens
AAVAREATSRLLAALLFHLSGHSSAASRSRNSPGSHLASLAFLPSLPTVVPPASRSLLADSEHKKDCHGFHCSSRGASDPFFISRRRRAVVTTTCGRSGGGANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQNMSEQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892952 - protein, 278 aa, Homo sapiens
MYKTQVQKLQEAAEIVKSRCENLLHKNNQITKTKNKNVEKMRGQMESHLKELERVCDSLTAAERRLHECQESLQCCKGKCADQEHTIRELQGQNMSEQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 892953 - protein, 95 aa, Homo sapiens
KQQTQQHPQSPRSREMGQRDSKCRHPIQRWSLVGQRRHSEVPVFLPMPTEALCEQSAGTFVTGIGKPKRHGSKHACVFPRKMGRAFQNRKKWFKL

SEQ ID NO: 892954 - protein, 127 aa, Homo sapiens
MIQAQESITLEDVAVDFTWEEWQLLGAAQKDLYRDVMLENYSNLVAVGYQASKPDALFKLEQGEQLWTIEDGIHSGACSGERTHKTEGYGSHILDSQRRQHSCEGGLRICKQFLYSSVSQCETSFSL

SEQ ID NO: 892955 - protein, 124 aa, Homo sapiens
MIQAQESITLEDVAVDFTWEEWQLLGAAQKDLYRDVMLENYSNLVAVGYQASKPDALFKLEQGEQLWTIEDGIHSGACSESCSVPRLERNGVNLAHRNLHLLDSSDSCAYPQHQHHTWHTVIIQ

SEQ ID NO: 892956 - protein, 532 aa, Homo sapiens
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 892957 - protein, 532 aa, Homo sapiens; identical to SEQ ID NO: 892956

SEQ ID NO: 892958 - protein, 929 aa, Homo sapiens
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 892959 - protein, 929 aa, Homo sapiens; identical to SEQ ID NO: 892958

SEQ ID NO: 892960 - protein, 616 aa, Homo sapiens
MVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 892961 - protein, 929 aa, Homo sapiens; identical to SEQ ID NO: 892958

SEQ ID NO: 892962 - protein, 929 aa, Homo sapiens; identical to SEQ ID NO: 892958

SEQ ID NO: 892963 - protein, 756 aa, Homo sapiens
MVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 892964 - protein, 929 aa, Homo sapiens; identical to SEQ ID NO: 892958

SEQ ID NO: 892965 - protein, 946 aa, Homo sapiens
MESMLNKLKSTVTKVTADVTSAVMGNPVTREFDVGRHIASGGNGLAWKIFNGTKKSTKQEVAVFVFDKKLIDKYQKFEKDQIIDSLKRGVQQLTRLRHPRLLTVQHPLEESRDCLAFCTEPVFASLANVLGNWENLPSPISPDIKDYKLYDVETKYGLLQVSEGLSFLHSSVKMVHGNITPENIILNKSGAWKIMGFDFCVSSTNPSEQEPKFPCKEWDPNLPSLCLPNPEYLAPEYILSVSCETASDMYSLGTVMYAVFNKGKPIFEVNKQDIYKSFSRQLDQLSRLGSSSLTNIPEEVREHVKLLLNVTPTVRPDADQMTKIPFFDDVGAVTLQYFDTLFQRDNLQKSQFFKGLPKVLPKLPKRVIVQRILPCLTSEFVNPDMVPFVLPNVLLIAEECTKEEYVKLILPELGPVFKQQEPIQILLIFLQKMDLLLTKTPPDEIKNSVLPMVYRALEAPSIQIQELCLNIIPTFANLIDYPSMKNALIPRIKNACLQTSSLAVRVNSLVCLGKILEYLDKWFVLDDILPFLQQIPSKEPAVLMGILGKLRLREVKYSDSRSYKGIYKCTFTHKKLGITKEQLAGKVLPHLIPLSIENNLNLNQFNSFISVIKEMLNRLESEHKTKLEQLHIMQEQQKSLDIGNQMNVSEEMKVTNIGNQQIDKVFNNIGADLLTGSESENKEDGLQNKHKRASLTLEEKQKLAKEQEQAQKLKSQQPLKPQVHTPVATVKQTKDLTDTLMDNMSSLTSLSVSTPKSSASSTFTSVPSMGIGMMFSTPTDNTKRNLTNGLNANMGFQTSGFNMPVNTNQNFYSSPSTVGVTKMTLGTPPTLPNFNALSVPPAGAKQTQQRPTDMSALNNLFGPQKPKVSMNQLSQQKPNQWLNQFVPPQGSPTMGSSVMGTQMNVIGQSAFGMQGNPFFNPQNFAQPPTTMTNSSSASNDLKDLFG

SEQ ID NO: 892966 - protein, 206 aa, Homo sapiens [sequence omitted]

SEQ ID NO: 892967 - protein, 761 aa, Homo sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 892968 - protein, 664 aa, Homo sapiens
MPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 892969 - protein, 624 aa, Homo sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 892970 - protein, 476 aa, Homo sapiens
MEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 892971 - protein, 422 aa, Homo sapiens
ERASSTEKIQYRNCPDQHYRPSVCTARRQLLHTDHVLPYRYDWTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 892972 - protein, 132 aa, Homo sapiens
MQVIHGPHVEKLQSPLGPHRPSPRCPLSVVTGPDLQECTFHSTRKPYDILRLPRPAACMGPLPSSTPTLRMVPCSALVLCWPLPATPTLRHPGVVGPNWLAPPSAALCRPDAAVWPDLPSSNILLVTPPPAK

SEQ ID NO: 892973 - protein, 866 aa, Homo sapiens
MAARAVLDEFTAPAEKAELLEQSRGRIEGLFGVSLAVLGALGAEEPLPARIWLQLCGAQEAEHSAKEYIKGICEPELEERECYPKDMHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRDETVLQEEARNKAGTPVSELTKQMDTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVSWREIITKRLLQYTFVGDIFMVPDDPLGRSGPRLEEFLQKEVCLRDMQPLLSALPNVGMFDPSFRVPGTQAASTTNTASDPDSGSPFKPLAPSAAPLPTAASPPQSPAEPAHASSEIFCRNQRAEGSPSEDLP

SEQ ID NO: 892974 - protein, 90 aa, Homo sapiens
AVVHTCMLFMGAPSSHWLPQQPHFPLLPALPSLQQNLPMPAQRSSAETNELREALLKIFPDSEQRLKIDQILVAHPYMKDLNALSAMVLD

SEQ ID NO: 892975 - protein, 105 aa, Homo sapiens
PGEKMGRTQNSFKLNLREIITKRLLQYTFVGDIFMVPDDPLGRSGPRLEEFLQKEVCLRDMQPLLSALPNVGMFDPSFRVPGTQAASTTNTASDPDSDTDQLHLN

SEQ ID NO: 892976 - protein, 692 aa, Homo sapiens
FFKTMGYSQEIVEKVIKVYGPSTEPLLLLEEIEKENKRFQEDREFSAGTVYPETNKTKNKGVYSSTNELTTDSISKENTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVSWREIITKRLLQYTFVGDIFMVPDDPLGRSGPRLEEFLQKEVCLRDMQPLLSALPNVGMFDPSFRVPGTQAASTTNTASDPDSGSPFKPLAPSAAPLPTAASPPQSPAEPAHASSEIFCRNQRAEGSPSEDLP

SEQ ID NO: 892977 - protein, 108 aa, Homo sapiens
MWACLTPASESLAPRQPAPPIQPPTRIQGAPSSHWLPQQPHFPLLPALPSLQQNLPMPAQRSSAETNELREALLKIFPDSEQRLKIDQILVAHPYMKDLNALSAMVLD

SEQ ID NO: 892978 - protein, 678 aa, Homo sapiens
MAARAVLDEFTAPAEKAELLEQSRGRIEGLFGVSLAVLGALGAEEPLPARIWLQLCGAQEAEHSAKEYIKGICEPELEERECYPKDMHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRDETVLQEEARNKAGTPVSELTKQMDTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTGFYYT

SEQ ID NO: 892979 - protein, 329 aa, Homo sapiens
MKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVSWREIITKRLLQYTFVGDIFMVPDDPLGRSGPRLEEFLQKEVCLRDMQPLLSALPNVGMFDPSFRVPGTQAASTTNTASDPDSGSPFKPLAPSAAPLPTAASPPQSPAEPAHASSEIFCRNQRAEGSPSEDLP

SEQ ID NO: 892980 - protein, 108 aa, Homo sapiens; identical to SEQ ID NO: 892977

SEQ ID NO: 892981 - protein, 752 aa, Homo sapiens
MAARAVLDEFTAPAEKAELLEQSRGRIEGLFGVSLAVLGALGAEEPLPARIWLQLCGAQEAEHSAKEYIKGICEPELEERECYPKDMHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRDETVLQEEARNKAGTPVSELTKQMDTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVLATLAGAAATDCVLSCCPF

SEQ ID NO: 892982 - protein, 113 aa, Homo sapiens
MVPDDPLGRSGPRLEEFLQKEVCLRDMQPLLSALPNVGMFDPSFRVPGTQAASTTNTASDPDSGSPFKPLAPSAAPLPTAASPPQSPAEPAHASSEIFCRNQRAEGSPSEDLP

SEQ ID NO: 892983 - protein, 742 aa, Homo sapiens
MAARAVLDEFTAPAEKAELLEQSRGRIEGLFGVSLAVLGALGAEEPLPARIWLQLCGAQEAEHSAKEYIKGICEPELEERECYPKDMHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRDETVLQEEARNKAGTPVSELTKQMDTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVSWREIITKR

SEQ ID NO: 892984 - protein, 52 aa, Homo sapiens
MVGLGGMSQLLLASLLPPVPQGSPTRRKLPASLLVSTALISPVCVRGWMWQN

SEQ ID NO: 892985 - protein, 173 aa, Homo sapiens
MDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 892986 - protein, 280 aa, Homo sapiens
PQFWIGRKEAELVLCISSPWPRCTRALVQAGLDLFGDGSAGVPAPWVLHLILPVPAPPETWGALASGAMKLLTLQPPGMLWLMERGGLGKPRGPRHRGLLRVRLGRFISRLLLWEPLGGGQAWGSGEGTQSLPRMGQPRISPWEAVGAPPGRGAHPISPLFPSQMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 892987 - protein, 129 aa, Homo sapiens
MSVNMDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPHPLPFPLLTKEKNEFQTTKKK

SEQ ID NO: 892988 - protein, 90 aa, Homo sapiens
MSVNMDELKHQVMINQFVLTAGCAADQAKQLLQAAHWQFETALSAFFQETNIPYSHHHHQMLPCTWGYPHPLPFPLLTKEKNEFQTTKKK

SEQ ID NO: 892989 - protein, 177 aa, Homo sapiens
MSVNMDELKHQVMINQFVLTAGCAADQAKQLLQAAHWQFETALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 892990 - protein, 183 aa, Homo sapiens
MEWFRAAWVPGGQNFRDHAAFLRRRTCPAQPRGAVEDHPGGDIADPWLGAPWGPAGLDPHPRECRASPHVCAWPCLCISTCVALQKQPSSWGSWTLHVSVSPQPPARRPLPRALPPPHPLVSQRCCSLQRKGLWETPGLFPPPPSACLLGLPACLPCTWGYPHPLPFPLLTKEKNEFQTTKKK

SEQ ID NO: 892991 - protein, 178 aa, Homo sapiens
HAPSRASRPLGCRPRSPGAPGAPWGLHIPACRGAGGARRGATALSAFFQETNIPYSHHHHQMMCTPANTPATPPNFPDALTMFSRLKASESFHSGGSGSPMAATATSPPPHFPHAATSSSAASSWPTAASPPGGPQHHQPQPPLWTPTPPSPASDWPPLAPQQATSEPRAHPAMEAER

SEQ ID NO: 892992 - protein, 239 aa, Homo sapiens
WWSEGSLCDGIDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFTKVRLLLSSLIPSPSKYS

SEQ ID NO: 892993 - protein, 163 aa, Homo sapiens
MPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGESSAPGAASSGPTSIP

SEQ ID NO: 892994 - protein, 163 aa, Homo sapiens; identical to SEQ ID NO: 892993

SEQ ID NO: 892995 - protein, 120 aa, Homo sapiens
GTLCDGIDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYVQPCDD

SEQ ID NO: 892996 - protein, 909 aa, Homo sapiens
MPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 892997 - protein, 909 aa, Homo sapiens; identical to SEQ ID NO: 892996

SEQ ID NO: 892998 - protein, 909 aa, Homo sapiens; identical to SEQ ID NO: 892996

SEQ ID NO: 892999 - protein, 689 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893000 - protein, 677 aa, Homo sapiens
RFCSVLPHSDGAPSWLSCPPDAQGWGCHGGIRVAGPRDQLCNDFCSLGLQDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893001 - protein, 306 aa, Homo sapiens
WWSEGSLCDGIDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893002 - protein, 298 aa, Homo sapiens
MEYDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893003 - protein, 712 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGSPAETRVPGRWLQVTVLLLAGAGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893004 - protein, 507 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYVQPCDD

SEQ ID NO: 893005 - protein, 620 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFRKVEDHYYKSIHCISP

SEQ ID NO: 893006 - protein, 626 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKWELILRVNPSKVRPIDQQKI

SEQ ID NO: 893007 - protein, 620 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSIVCHYFGVYSIAIEI

SEQ ID NO: 893008 - protein, 507 aa, Homo sapiens; identical to SEQ ID NO: 893004

SEQ ID NO: 893009 - protein, 363 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLPGPWNVMFLVISKGCSFILGG

SEQ ID NO: 893010 - protein, 306 aa, Homo sapiens
EKEETEDFKEREEALQVTTVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893011 - protein, 587 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAALRKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 893012 - protein, 622 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFTKVRLLLSSLIPSPSKYS

SEQ ID NO: 893013 - protein, 625 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTEVKSIAKVTSRVA

SEQ ID NO: 893014 - protein, 558 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLEVQNSHLY

SEQ ID NO: 893015 - protein, 576 aa, Homo sapiens
MNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAALRKTPGTATCAGTRVPTGCCGGERTGPPGSRCSSLITTTRNLTLQRFTHLSQLRRGSPSGCCLSLMESLQIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTEVKSIAKVTSRVA

SEQ ID NO: 893016 - protein, 361 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 893017 - protein, 361 aa, Homo sapiens; identical to SEQ ID NO: 893016

SEQ ID NO: 893018 - protein, 386 aa, Homo sapiens
RDGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 893019 - protein, 386 aa, Homo sapiens; identical to SEQ ID NO: 893018

SEQ ID NO: 893020 - protein, 386 aa, Homo sapiens; identical to SEQ ID NO: 893018

SEQ ID NO: 893021 - protein, 386 aa, Homo sapiens; identical to SEQ ID NO: 893018

SEQ ID NO: 893022 - protein, 386 aa, Homo sapiens; identical to SEQ ID NO: 893018

SEQ ID NO: 893023 - protein, 69 aa, Homo sapiens
PQIVDALHALLDRLQALIGTRFVTTPGLFSVHCSLSVTFLLVSPYGTLQRLPFLSFLLKLGNSTPEIDR

SEQ ID NO: 893024 - protein, 386 aa, Homo sapiens; identical to SEQ ID NO: 893018

SEQ ID NO: 893025 - protein, 386 aa, Homo sapiens; identical to SEQ ID NO: 893018

SEQ ID NO: 893026 - protein, 386 aa, Homo sapiens; identical to SEQ ID NO: 893018

SEQ ID NO: 893027 - protein, 386 aa, Homo sapiens; identical to SEQ ID NO: 893018

SEQ ID NO: 893028 - protein, 353 aa, Homo sapiens
RDGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKDLQEVTQDLHYENFRSERLKRGGRKVENEDMNKDQILLEKEAELRRMQEMIARMQAQMQMQMQGGDGDGGALGHHV

SEQ ID NO: 893029 - protein, 316 aa, Homo sapiens
RDGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMRKWRMRT

SEQ ID NO: 893030 - protein, 386 aa, Homo sapiens; identical to SEQ ID NO: 893018

SEQ ID NO: 893031 - protein, 95 aa, Homo sapiens
RDGRVRGAVGRRLFSGCLADEASQKMSKQQPTQFINPETPGYVGFANLPNQVHRKSVKKGFEFTLMVVGESGLGKSTLINSLFLCLPGSPDLSFL

SEQ ID NO: 893032 - protein, 386 aa, Homo sapiens; identical to SEQ ID NO: 893018

SEQ ID NO: 893033 - protein, 386 aa, Homo sapiens; identical to SEQ ID NO: 893018

SEQ ID NO: 893034 - protein, 386 aa, Homo sapiens; identical to SEQ ID NO: 893018

SEQ ID NO: 893035 - protein, 386 aa, Homo sapiens; identical to SEQ ID NO: 893018

SEQ ID NO: 893036 - protein, 185 aa, Homo sapiens
MMEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 893037 - protein, 168 aa, Homo sapiens
MMEEIDRFQVPTAHSEMQPLDPAAASISDGDCDAREEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 893038 - protein, 185 aa, Homo sapiens; identical to SEQ ID NO: 893036

SEQ ID NO: 893039 - protein, 185 aa, Homo sapiens; identical to SEQ ID NO: 893036

SEQ ID NO: 893040 - protein, 185 aa, Homo sapiens; identical to SEQ ID NO: 893036

SEQ ID NO: 893041 - protein, 157 aa, Homo sapiens
MMEEIDRFQVPTAHSEMQPLDPAAASISDGDCDAREGESVAMNYKPSPLQVKLEKQRELARKGSLKNGSMGSPVNQQPKKNNVMARTRLVVPNKGYSSLDQSPDEKPLVALDTDRCVWGLGGSWAAQRNLYSTSGLYRPHLLYCQNWDILQPESLQG

SEQ ID NO: 893042 - protein, 161 aa, Homo sapiens
MMEEIDRFQDPAAASISDGDCDAREEKQRELARKGSLKNGSMGSPVNQQPKKNNVMARTRLVVPNKGYSSLDQSPDEKPLVALDTDSDDKLMNMSRYIAPSGLTPLAEQDSTQDLNIQTARGTATGLRSRIPENEDHRLIPPSQKPTAIVPGRSPRMKSIR

SEQ ID NO: 893043 - protein, 116 aa, Homo sapiens
MGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 893044 - protein, 174 aa, Homo sapiens
MMEEIDRFQDPAAASISDGDCDAREGESVAMNYKPSPLQVKLEKQRELARKGSLKNGSMGSPVNQQPKKNNVMARTRLVVPNKGYSSLDQSPDEKPLVALDTDSDDDFDMSRYSSSGYSSAEQINQDLNIQLLKDGYRLDEIPDDEDLDLIPPKSVNPTCMCCQATSSTACHIQ

SEQ ID NO: 893045 - protein, 185 aa, Homo sapiens; identical to SEQ ID NO: 893036

SEQ ID NO: 893046 - protein, 205 aa, Homo sapiens
RESAAVAELLTGGGSGVGGEARPAARPGHSRGSARQAHGVTPASASLRTSRPRPPLHPPGPCPPEWSGEAYVCTTRRAPGAAAPRGPVGVRGRARPLARSPAGTMMEEIDRFQVPTAHSEMQPLDPAAASISDGDCDAREGESVAMNYKPSPLQVKLVWLYRVSVDQDVYTAASAIAGLGEGTGKLRLKIKREEVRKAHPWGWAV

SEQ ID NO: 893047 - protein, 1063 aa, Homo sapiens
PALVCLFSTRAPAAVTWLSGWSLRTQGGFVTGRLETVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRNCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 893048 - protein, 213 aa, Homo sapiens
PALVCLFSTRAPAAVTWLSGWSLRTQGGFVTGRLETVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATETLILAFSLMNHL

SEQ ID NO: 893049 - protein, 136 aa, Homo sapiens
MAPVLSKDSADIESILALNPRTQTHATLCSTSAKKLDKKHWKRNPDKNCFKLQGPVPGLRASGSTTVTCHSSSRTSLTQSTMANNTVLCDSRRPLLSYLKVRQESLAYHYELFENTRIQFLLWNRNKCLAIEDRPQ

SEQ ID NO: 893050 - protein, 454 aa, Homo sapiens
PALVCLFSTRAPAAVTWLSGWSLRTQGGFVTGRLETVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPLLWFFLAVRSHKGVELPFGHCLAIIESGKRSVCSTSFIFR

SEQ ID NO: 893051 - protein, 417 aa, Homo sapiens
PALVCLFSTRAPAAVTWLSGWSLRTQGGFVTGRLETVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPSSA

SEQ ID NO: 893052 - protein, 207 aa, Homo sapiens
PALVCLFSTRAPAAVTWLSGWSLRTQGGFVTGRLETVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVCMIYT

SEQ ID NO: 893053 - protein, 165 aa, Homo sapiens
PALVCLFSTRAPAAVTWLSGWSLRTQGGFVTGRLETVGTAMAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKMESCSVARLECSGTISAH

SEQ ID NO: 893054 - protein, 1045 aa, Homo sapiens
PALVCLFSTRAPAAVTWLSGWSLRTQGGFVTGRLETVGTAMAPVLSKDSADIESILALNPRTQTHATLCSTSAKKLDKKHWDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRNCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 893055 - protein, 554 aa, Homo sapiens
PIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 893056 - protein, 444 aa, Homo sapiens
PIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSAVSTSFLIKGRNL

SEQ ID NO: 893057 - protein, 554 aa, Homo sapiens; identical to SEQ ID NO: 893055

SEQ ID NO: 893058 - protein, 510 aa, Homo sapiens
PIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKGE

SEQ ID NO: 893059 - protein, 516 aa, Homo sapiens
PIFDIPGRLYPVREKFCNLIGPRDRENTAYIQAIVKVTMDIHLNEMAGDILVFLTGQFEIEKSCELLFQMAESVDYDYDVQDTTLDGLLILPCYGSMTTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKVTIKQFKDRISRVHH

SEQ ID NO: 893060 - protein, 294 aa, Homo sapiens
MVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHEVLVTTKVYARIVCPIRYEWVRDLLPKLHEFNAHDLSSVARREVREDARRRWTNKENVKQLKDGISKDVLKKMQRRNDDKSISDARARFLERKQQRTQDHSDTRKETG

SEQ ID NO: 893061 - protein, 444 aa, Homo sapiens; identical to SEQ ID NO: 893056

SEQ ID NO: 893062 - protein, 554 aa, Homo sapiens; identical to SEQ ID NO: 893055

SEQ ID NO: 893063 - protein, 417 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893064 - protein, 280 aa, Homo sapiens
MALLTLGINSAMVLDCGYRESLVLPIYEGIPVLNCWGALPLGGKALHKELETQLLEQCTVDTSVAKEQSLPSVMARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893065 - protein, 265 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSISVR

SEQ ID NO: 893066 - protein, 392 aa, Homo sapiens
MCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893067 - protein, 292 aa, Homo sapiens
MALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893068 - protein, 384 aa, Homo sapiens
MMSNVNLRAALPPNLSRIGTGISFVHTCNHIVIYKMKCIEDAILQHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893069 - protein, 219 aa, Homo sapiens
MGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893070 - protein, 325 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLEMMFDVGKTQPPLMKRAFSTEK

SEQ ID NO: 893071 - protein, 191 aa, Homo sapiens
MCGLMFMIFIFQRPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893072 - protein, 263 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPTTESLIDPRICKIFSPSNVD

SEQ ID NO: 893073 - protein, 81 aa, Homo sapiens
VAEPQALPGSSSPTRWAAPGLPFSSTSALANNSSYYFLPGRCESEDRGLTPREAQKASVELPSSPPLVITPNPTNPLGSSV

SEQ ID NO: 893074 - protein, 417 aa, Homo sapiens; identical to SEQ ID NO: 893063

SEQ ID NO: 893075 - protein, 159 aa, Homo sapiens
MGIMRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893076 - protein, 370 aa, Homo sapiens [sequence omitted]

SEQ ID NO: 893077 - protein, 399 aa, Homo sapiens
MPLYEGLGSGGEKTAVVIDLGEAFTKCGFAGETGPRCIIPSVIEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893078 - protein, 402 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHNVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 893079 - protein, 219 aa, Homo sapiens; identical to SEQ ID NO: 893069

SEQ ID NO: 893080 - protein, 191 aa, Homo sapiens; identical to SEQ ID NO: 893071

SEQ ID NO: 893081 - protein, 126 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFERVGNSTIGTMYC

SEQ ID NO: 893082 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 893083 - protein, 182 aa, Homo sapiens
MPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 893084 - protein, 131 aa, Homo sapiens
ILAHLICVKKYPFFQFTEAVSPSVLPPSALPLDLLNNAITAFSTLEDLIRYLEPERWQLDLEDLYRPTWQLLGKAFVFGRKSRVVDLNLLTEEVVSWLNAVVGTVPVVSTIAMNVNVSQAKLLKNTTRSFS

SEQ ID NO: 893085 - protein, 345 aa, Homo sapiens; identical to SEQ ID NO: 893082

SEQ ID NO: 893086 - protein, 182 aa, Homo sapiens; identical to SEQ ID NO: 893083

SEQ ID NO: 893087 - protein, 142 aa, Homo sapiens
MPQFTEAVSPSVLPPSALPLDLLNNAITAFSTLEDLIRYLEPERWQLDLEDLYRPTWQLLGKAFVFGRKSRGDNYEKEKNLKTNFYKYLAEGNFFNIIIVKLFKKYPLVHYLSFFFSFFSLFAFPPQKYYTMFQECMTYDLT

SEQ ID NO: 893088 - protein, 411 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 893089 - protein, 1103 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 893090 - protein, 980 aa, Homo sapiens
EGKRGGGEGAGPRSRRAGLPALQRARRLPLPADALAPARGCRSPSPGVSWTPGVSWTPGAGGSGARRWTGAEPQDCAPGSGRPEKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893091 - protein, 922 aa, Homo sapiens
SQGARRNLSGKRQFSLRRFEARALGRKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893092 - protein, 924 aa, Homo sapiens
MTGPGFSCNRGAWPTTHMRRFEARALGRKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893093 - protein, 355 aa, Homo sapiens
ARSPSFLSHEENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893094 - protein, 1237 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGPRGHTG

SEQ ID NO: 893095 - protein, 114 aa, Homo sapiens
TLSQCCVKKEVIEGGPGLGMSSGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893096 - protein, 1103 aa, Homo sapiens; identical to SEQ ID NO: 893089

SEQ ID NO: 893097 - protein, 1322 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893098 - protein, 1288 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893099 - protein, 859 aa, Homo sapiens
MEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893100 - protein, 1103 aa, Homo sapiens; identical to SEQ ID NO: 893089

SEQ ID NO: 893101 - protein, 99 aa, Homo sapiens
NMLQNCSRKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 893102 - protein, 823 aa, Homo sapiens
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVAFTVRKAGRYEITVKLGGLNVAYSPYYKIFQPGMVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 893103 - protein, 662 aa, Homo sapiens
MVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 893104 - protein, 648 aa, Homo sapiens
MVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 893105 - protein, 157 aa, Homo sapiens
VNTCQPLYSPLLHQLSGRRTKEGGSLLGSLLNELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 893106 - protein, 220 aa, Homo sapiens
MVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKVGPSILDIKSPCLNLCVIGIW

SEQ ID NO: 893107 - protein, 662 aa, Homo sapiens; identical to SEQ ID NO: 893103

SEQ ID NO: 893108 - protein, 552 aa, Homo sapiens
IPYYTSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 893109 - protein, 662 aa, Homo sapiens; identical to SEQ ID NO: 893103

SEQ ID NO: 893110 - protein, 126 aa, Homo sapiens
ARKRKLLGERAIPRAGSQAGWRPTLGSVGGRVGSPSSAECCRPFPGQRRWNFVALQPPARVTFLSSLRQSPEDLPLPEFQREREEKGSWGVLWQSIAPCTREKSRNDIFLGCISLPWSSSSSSQKH

SEQ ID NO: 893111 - protein, 1128 aa, Homo sapiens
MVRYPAQERGRGGSPGGEALPTLSPAPNLQGDAVRRGKSIAETRGREMLMPSVTLLAGKLCPSPVPGSPQIAGLPNDTLSVENGVINQFSQRWTHFIDPQSQANKWIKNMEKDNGLDVFKLGDRDFLRSMENAIRFGKPCLLENVGEELDPALEPVLLKQTYKQQGSTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERRKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEIVEDVTQNILLKVPEPINLQWVMAKYPVLYEESMNTVLVQEVIRYNRLLQVITQTLQDLLKALKGLVVMSSQLELMAASLYNNTVPELWSAKAYPSLKPLSSWVMDLLQRLDFLQAWIQDGIPAVFWISGFFFPQAFLTGTLQNFARKFVISIDTISFDFKVMFEAPSELTQRPQVGCYIHGLFLEGARWDPEAFQLAESQPKELYTEMAVIWLLPTPNRKAQDQDFYLCPIYKTLTRAGTLSTTGHSTNYVIAVEIPTHQPQRHWIKRGVALICALDY

SEQ ID NO: 893112 - protein, 1242 aa, Homo sapiens
MVRYPAQERGRGGSPGGEALPTLSPAPNLQGDAVRRGKSIAETRGREMLMPSVTLLAGKLCPSPVPGSPQIAGLPNDTLSVENGVINQFSQRWTHFIDPQSQANKWIKNMEKDNGLDVFKLGDRDFLRSMENAIRFGKPCLLENVGEELDPALEPVLLKQTYKQQGSTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERRKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEIVEDVTQNILLKVPEPINLQWVMAKYPVLYEESMNTVLVQEVIRYNRLLQVITQTLQDLLKALKGLVVMSSQLELMAASLYNNTVPELWSAKAYPSLKPLSSWVMDLLQRLDFLQAWIQDGIPAVFWISGFFFPQAFLTGTLQNFARKFVISIDTISFDFKVWAQPGPGQVTGYGTAQGGEALRPRLVGSWGTPKPGHGKTQARRGHESQERVWAGSIRNPQGQGTDHRPWAKVVVRDDGQAGSIRQLSQKGVLCLLTQILGIVMCVGCVCVYPQVMFEAPSELTQRPQVGCYIHGLFLEGARWDPEAFQLAESQPKELYTEMAVIWLLPTPNRKAQDQDFYLCPIYKTLTRAGTLSTTGHSTNYVIAVEIPTHQPQRHWIKRGVALICALDY

SEQ ID NO: 893113 - protein, 1143 aa, Homo sapiens
MVRYPAQERGRGGSPGGEALPTLSPAPNLQGDAVRRGKSIAETRGREMLMPSVTLLAGKLCPSPVPGSPQIAGLPNDTLSVENGVINQFSQRWTHFIDPQSQANKWIKNMEKDNGLDVFKLGDRDFLRSMENAIRFGKPCLLENVGEELDPALEPVLLKQTYKQQGSTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERRKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEIVEDVTQNILLKVPEPINLQWVMAKYPVLYEESMNTVLVQEVIRYNRLLQVITQTLQDLLKALKGLVVMSSQLELMAASLYNNTVPELWSAKAYPSLKPLSSWVMDLLQRLDFLQAWIQDGIPAVFWISGFFFPQAFLTGTLQNFARKFVISIDTISFDFKVMFEAPSELTQRPQVGCYIHGLFLEGARWDPEAFQLAESQPKELYTEMAVIWLLPTPNRKAQDQDFYLCPIYKTLTRAGMRPGMGAYTMGGDPGLTQPSPSQSLIQEHYQPQDTLPTMSLLWRSPPISPSDTG

SEQ ID NO: 893114 - protein, 76 aa, Homo sapiens
MEYIPVAIRTQILFFCVSDLANVDPMYQYSLEWFLNIFLSGIANSERAGSTGMPGSYPATDMTHVDTFPLWGTHKL

SEQ ID NO: 893115 - protein, 336 aa, Homo sapiens
MAVATAAAVLAALGGALWLAARRFVGPRVQRLRRGGDPGLMHGKTVLITGANSGLGRATAAELLRLGARVIMGCRDRARAEEAAGQLRRELRQAAECGPEPGVSGVGELIVRELDLASLRSVRAFCQEMLQEEPRLDVLINNAGIFQCPYMKTEDGFEMQFGVNHLGHFLLTNLLLGLLKSSAPSRIVVVSSKLYKYGDINFDDLNSEQSYNKSFCYSRSKLANILFTRELARRLEGTNVTVNVLHPGIVRTNLGRHIHIPLLVKPLFNLVSWAFFKTPVEGAQTSIYLASSPEVEGVSGRYFGDCKEEELLPKAMDESVARKLWDISEVMVGLLK

SEQ ID NO: 893116 - protein, 336 aa, Homo sapiens; identical to SEQ ID NO: 893115

SEQ ID NO: 893117 - protein, 219 aa, Homo sapiens
QGGRRGKVLRLGKDEEPRLDVLINNAGIFQCPYMKTEDGFEMQFGVNHLGHFLLTNLLLGLLKSSAPSRIVVVSSKLYKYGDINFDDLNSEQSYNKSFCYSRSKLANILFTRELARRLEGTNVTVNVLHPGIVRTNLGRHIHIPLLVKPLFNLVSWAFFKTPVEGAQTSIYLASSPEVEGVSGRYFGDCKEEELLPKAMDESVARKLWDISEVMVGLLK

SEQ ID NO: 893118 - protein, 186 aa, Homo sapiens [sequence omitted]

SEQ ID NO: 893119 - protein, 386 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTEEQLQMTAD

SEQ ID NO: 893120 - protein, 386 aa, Homo sapiens; identical to SEQ ID NO: 893119

SEQ ID NO: 893121 - protein, 386 aa, Homo sapiens; identical to SEQ ID NO: 893119

SEQ ID NO: 893122 - protein, 386 aa, Homo sapiens; identical to SEQ ID NO: 893119

SEQ ID NO: 893123 - protein, 355 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVLRSTEHAAVQGR

SEQ ID NO: 893124 - protein, 378 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTE

SEQ ID NO: 893125 - protein, 386 aa, Homo sapiens; identical to SEQ ID NO: 893119

SEQ ID NO: 893126 - protein, 137 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKR

SEQ ID NO: 893127 - protein, 313 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVNERTG

SEQ ID NO: 893128 - protein, 223 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQVVDGFSSD

SEQ ID NO: 893129 - protein, 137 aa, Homo sapiens; identical to SEQ ID NO: 893126

SEQ ID NO: 893130 - protein, 116 aa, Homo sapiens
GFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVGNTDRCCRQEVCMGND

SEQ ID NO: 893131 - protein, 99 aa, Homo sapiens
GVNRDSASARTKAGSCAGRRKAWGIRPSELGSVCDAAARSREPLPAERERGGAQNEAGRRPLFPWGHAQPEVAAAAENWRWGPPWTSRLKERIKFITPG

SEQ ID NO: 893132 - protein, 297 aa, Homo sapiens
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 893133 - protein, 121 aa, Homo sapiens
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQVRAS

SEQ ID NO: 893134 - protein, 297 aa, Homo sapiens; identical to SEQ ID NO: 893132

SEQ ID NO: 893135 - protein, 255 aa, Homo sapiens
MEGTVNLQLSAKSVGVFEAFYNSVKPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 893136 - protein, 297 aa, Homo sapiens; identical to SEQ ID NO: 893132

SEQ ID NO: 893137 - protein, 270 aa, Homo sapiens
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 893138 - protein, 172 aa, Homo sapiens
MGTALDIKIKRANKVYHAGPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 893139 - protein, 72 aa, Homo sapiens
FLMSYDISRRYPIFTPIAKRPIARYNSPGRDSFGQSLCTTPVPAWNGSGHLEIQLVIQILRGATASGIYLFL

SEQ ID NO: 893140 - protein, 120 aa, Homo sapiens
GVNRDSASARTKAGSCAGRRKAWGIRPSELGSVCDAAARSREPLPAERERGGAQNEAGRRPLFPWGHAQPEVAAAAENWRWGPPWTSRLKERIKFITPGKCSLAWWSYRVRIQSNTRECL

SEQ ID NO: 893141 - protein, 297 aa, Homo sapiens; identical to SEQ ID NO: 893132

SEQ ID NO: 893142 - protein, 297 aa, Homo sapiens; identical to SEQ ID NO: 893132

SEQ ID NO: 893143 - protein, 297 aa, Homo sapiens; identical to SEQ ID NO: 893132

SEQ ID NO: 893144 - protein, 121 aa, Homo sapiens; identical to SEQ ID NO: 893133

SEQ ID NO: 893145 - protein, 827 aa, Homo sapiens
WPESRAPAAAGAARRVSVRCGRSGPGPGRGAAGLSPADIALASEQGASCSVRAPERKLRMKLLWQAKMSSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 893146 - protein, 109 aa, Homo sapiens
MHTRAPSIVLIAGDIASDCALLEAAFLSRKPVSWDWNYPSWPAGSPQGRSRKVKSYLSVLCDSIATGSAEPELGIKSIGREGNVSGQALGSGGNNWGEFVEFGKGSLTS

SEQ ID NO: 893147 - protein, 105 aa, Homo sapiens
MHTRAPSIVLIAGDIASDCALLEAAFLSRKPVSWDWNYPSWPAGSPQGRSRKVKSYLSVLCDSIATGSAEPELVCSFLKGRDFVHLVHYYMPSVWNSLHGGMVPE

SEQ ID NO: 893148 - protein, 803 aa, Homo sapiens
MEVKPVGEPTQEVSKFKLSTKVESTGHWLVEDHVRIWEVLKTEESSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 893149 - protein, 101 aa, Homo sapiens
AVAAHTWPLCRLLPARPPLPTLTHLPWTGPPSPRSRACGTPMKMTSRKSARSCQVNTSGTRASPSPSACTRSRASAWRRTPKMCGTTTSLSSPTPSQARPG

SEQ ID NO: 893150 - protein, 67 aa, Homo sapiens
EDPLIWILKMTSRKSARSCQVNTSGTRASPSPSACTRSRASAWRRTPKMCGTTTSLSSPTPSQARPG

SEQ ID NO: 893151 - protein, 101 aa, Homo sapiens; identical to SEQ ID NO: 893149

SEQ ID NO: 893152 - protein, 67 aa, Homo sapiens; identical to SEQ ID NO: 893150

SEQ ID NO: 893153 - protein, 350 aa, Homo sapiens [sequence omitted]

SEQ ID NO: 893154 - protein, 358 aa, Homo sapiens
WGGAARPGGAGSGGAAARLRCARARAGRGRRWASGAPTRPPWGGRNGRRCGARALSRRGLTRRCFGRRPARGAGGAAMGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893155 - protein, 281 aa, Homo sapiens
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893156 - protein, 132 aa, Homo sapiens [sequence omitted]

SEQ ID NO: 893157 - protein, 132 aa, Homo sapiens [sequence omitted]

SEQ ID NO: 893158 - protein, 219 aa, Homo sapiens
MAPGEGGEAAFLTPWKAPTPLLQSCQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893159 - protein, 262 aa, Homo sapiens
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDERQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893160 - protein, 132 aa, Homo sapiens [sequence omitted]

SEQ ID NO: 893161 - protein, 358 aa, Homo sapiens; identical to SEQ ID NO: 893154

SEQ ID NO: 893162 - protein, 132 aa, Homo sapiens
MPAPAAPLHGHHRLGLPTALVLTSTSCPQAVRHDMASTQKEPSRDPGPPVVDSAAHASQGGPTEGVTGHQWTRPMARSWEMRAVACMNYQMSKGTPGRRPCHSPQRHWPPAPASLSWPHLSCCCQQGPCLGL

SEQ ID NO: 893163 - protein, 281 aa, Homo sapiens; identical to SEQ ID NO: 893155

SEQ ID NO: 893164 - protein, 311 aa, Homo sapiens
WGGAARPGGAGSGGAAARLRRPARGAGGAAMGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893165 - protein, 132 aa, Homo sapiens [sequence omitted]

SEQ ID NO: 893166 - protein, 198 aa, Homo sapiens
KSLLQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893167 - protein, 408 aa, Homo sapiens
WGGAARPGGAGSGGAAARLRCARARAGRGRRWASGAPTRPPWGGRNGRRCGARALSRRGLTRRCFGRRPARGAGGAAMGSQGSPVKSYDYLLKFLLVGDSDVGKGEILESLQDGAAESPYAYSNGIDYKTTTILLDGRRVKLELWDTSGQGRFCTIFRSYSRGAQLCPRYSRGDSLMELAERTLSFHSCTSPGCQNPASACPGNFHRLMAPGEGGEAAFLTPWKAPTPLLQSCQGILLVYDITNRWSFDGIDRWIKEIDERQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 893168 - protein, 388 aa, Homo sapiens
WGGAARPGGAGSGGAAARLRCARARAGRGRRWASGAPTRPPWGGRNGRRCGARALSRRGLTRRCFGRRPARGAGGAAMGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSVTIAWACPQHWCSPLPPVLRPCGTTWPARRRSPPGTQDPPWWTPRHMLPKVVPRRVLLGTSGLAPWPVPGR

SEQ ID NO: 893169 - protein, 1568 aa, Homo sapiens
SEWNKSGTFKMLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGEVIIIHCNLQFLALNDPAASAFQSAGLTGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDDTAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQVRAGEYSQVFRGLSNMYHLLICHLLACCTMDSPKIICI

SEQ ID NO: 893170 - protein, 929 aa, Homo sapiens
MGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQVRAGEYSQVFRGLSNMYHLLICHLLACCTMDSPKIICI

SEQ ID NO: 893171 - protein, 660 aa, Homo sapiens
SEWNKSGTFKMLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDDTAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETVSNDPRVRTWDFKSVLQQDVSFGLCDAPSRRGGLTEPILLLVYLGKNIMTREFC

SEQ ID NO: 893172 - protein, 596 aa, Homo sapiens [sequence omitted]

SEQ ID NO: 893173 - protein, 772 aa, Homo sapiens
SEWNKSGTFKMLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDDTAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQKELGTFAQSSIALHHQYNPKFQTLFQPCNLMGAMQLIEDFSTHVSIDCSPHKTVKKTGRRQMCQL

SEQ ID NO: 893174 - protein, 1539 aa, Homo sapiens
SEWNKSGTFKMLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDDTAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKEEERSQPTKTPSSSQEPPDEGTSGTDVNKGSSKNALSSMDPEVRLSSPPGKPEDSSSVDGQSVGTPVGPETGGEKNGPEEEEEEDFDDLTQDEEDEMSSASEESVLSVPELQVRAGEYSQVFRGLSNMYHLLICHLLACCTMDSPKIICI

SEQ ID NO: 893175 - protein, 1539 aa, Homo sapiens; identical to SEQ ID NO: 893174

SEQ ID NO: 893176 - protein, 1431 aa, Homo sapiens
SEWNKSGTFKMLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDDTAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKIVFTKAEDNLLALGLKHFEGTEFPNPLISKYLLTCKTAHQLTVRIKNLNMNRAPDNIIKFYKKTKQLPVLGKCCEEIQPHQWKPPIEREEHRLPFWLKASLPSIQEELRHMADGAREVGNMTGTTEINSDRSLEKDNLELGSESRYPLLLPKGVVLKLKPVATRFPRKAWRQKRSSVLKPLLIQPSPSLQPSFNPGKTPARSTHSEAPPSKMVLRIPHPIQPATVLQTVPGVPPLGVSGGESFESPAALPAVPPEARTSFPLSESQTLLSSAPVPKVMLPSLAPSKFRKPYVRRRPSKRRGVKASPCMKPAPVIHHPASVIFTVPATTVKIVSLGGGCNMIQPVNAAVAQSPQTIPITTLLVNPTSFPCPLNQSLVASSVSPLIVSGNSVNLPIPSTPEDKAHVNVDIACAVADGENAFQGLEPKLEPQELSPLSATVFPKVEHSPGPPLADAECQEGLSENSACRWTVVKTEEGRQALEPLPQGIQESLNNPTPGDLEEIVKMEPEEAREEISGSPERDICDDIKVEHAVELDTGAPSEELSSAGEVTKQTVLQKLEERRMGQKKRKKRTLMTSPKMRKMKCHQLLRNLCFLSQNSR

SEQ ID NO: 893177 - protein, 801 aa, Homo sapiens
SEWNKSGTFKMLPCKKRRTTVTESLQHKGNQEENNVDLESAVKPESDQVKDLSSVSLSWDPSHGRVAGFEVQSLQDAGNQLGMEDTSLSSGMLTQNTNVPILEGVDVAISQGITLPSLESFHPLNIHIGKGKLHATGSKRGKKMTLRPGPVTQEDRCDHLTLKEPFSGEPSEEVKEEGGKPQMNSEGEIPSLPSGSQSAKPVSQPRKSTQPDVCASPQEKPLRTLFHQPEEEIEDGGLFIPMEEQDNEESEKRRKKKKGTKRKRDGRGQEGTLAYDLKLDDMLDRTLEDGAKQHNLTAVNVRNILHEVITNEHVVAMMKAAISETEDMPMFEPKMTRSKLKEVVEKGVVIPTWNISPIKKANEIKPPQFVDIHLEEDDSSDEEYQPDDEEEDDTAEESLLESDVESTASSPRGAKKSRLRQSSEMTETDEESGILSEAEKVTTPAIRHISAEVVPMGPPPPPKPKQTRDSTFMEKLHAVDEELASSPVCMDSFQPMDDSLIAFRTRSKMPLKDVPLGQLEAELQAPDITPDMYDPNTADDEDWKMWLGGLMNDDVGNEDEADDDDDPEYNFLEDLDEPDTEDFRTDRAVRITKKEVNELMEELFETFQDEMGFSNMEDDGPEEEECVAEPRPNFNTPQALRFEEPLANLLNEQHRTVKELFEQLKMKKSSAKQLQEVEKVKPQSEKVHQTLILDPAQRKRLQQQMQQHVQLLTQIHLLATCNPNLNPEATTTRIFLKELGTFAQSSIALHHQYNPKFQTLFQPCNLMGAMQLIEDFSTHVSIDCSPHKTVKKTGRRQMCQL

SEQ ID NO: 893178 - protein, 476 aa, Homo sapiens
MISLALGNYSTSGTRISSSAMPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 893179 - protein, 103 aa, Homo sapiens
LLWVLRSSQKTPSHYGDAPPTPQPKCADFQSANLFEGTDLKVQFLLFVPSNPSCGQLVEGSSDLQNSGFNATLGTKLIIHGFRWELNNQQDFSTKNDQVTIIP

SEQ ID NO: 893180 - protein, 378 aa, Homo sapiens
MISLALGNYSTSGTRISSSAMPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCNAFQLLTVAPNRGISLKLGCW

SEQ ID NO: 893181 - protein, 442 aa, Homo sapiens
MISLALGNYSTSGTRISSSAMPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITDLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 893182 - protein, 283 aa, Homo sapiens
MVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 893183 - protein, 406 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 893184 - protein, 406 aa, Homo sapiens; identical to SEQ ID NO: 893183

SEQ ID NO: 893185 - protein, 362 aa, Homo sapiens [sequence omitted]

SEQ ID NO: 893186 - protein, 362 aa, Homo sapiens [sequence omitted]

SEQ ID NO: 893187 - protein, 406 aa, Homo sapiens; identical to SEQ ID NO: 893183

SEQ ID NO: 893188 - protein, 406 aa, Homo sapiens; identical to SEQ ID NO: 893183

SEQ ID NO: 893189 - protein, 419 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGLEDNGALQPPPPSAVPGIGPSLQKPFQEYLEAQRQKLHHKSEMGTPQGENWLSWMFEKLVVVMVCYFILSIINSMAQSYAKRIQQRLNSEEKTK

SEQ ID NO: 893190 - protein, 338 aa, Homo sapiens
QRIPLFVLHIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 893191 - protein, 309 aa, Homo sapiens
MDLKYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 893192 - protein, 406 aa, Homo sapiens; identical to SEQ ID NO: 893183

SEQ ID NO: 893193 - protein, 272 aa, Homo sapiens
MDLKGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 893194 - protein, 172 aa, Homo sapiens
MDLKDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 893195 - protein, 406 aa, Homo sapiens; identical to SEQ ID NO: 893183

SEQ ID NO: 893196 - protein, 106 aa, Homo sapiens [sequence omitted]

SEQ ID NO: 893197 - protein, 107 aa, Homo sapiens
DFYQPLAFPVALAHWHAGLGSSTHNACSPPPCGCQAKPPATFITKLHSLLPGILFPSFTTKSKWAHHREKTGCPGCLKSWSLSWCVTSSYLSLTPWHKVMPNESSSG

SEQ ID NO: 893198 - protein, 406 aa, Homo sapiens; identical to SEQ ID NO: 893183

SEQ ID NO: 893199 - protein, 406 aa, Homo sapiens; identical to SEQ ID NO: 893183

SEQ ID NO: 893200 - protein, 362 aa, Homo sapiens [sequence omitted]

SEQ ID NO: 893201 - protein, 362 aa, Homo sapiens [sequence omitted]

SEQ ID NO: 893202 - protein, 362 aa, Homo sapiens [sequence omitted]

SEQ ID NO: 893203 - protein, 362 aa, Homo sapiens [sequence omitted]

SEQ ID NO: 893204 - protein, 483 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 893205 - protein, 480 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEVRQTYHWGKTTICKDDCLCSVGC

SEQ ID NO: 893206 - protein, 483 aa, Homo sapiens; identical to SEQ ID NO: 893204

SEQ ID NO: 893207 - protein, 342 aa, Homo sapiens [sequence omitted]

SEQ ID NO: 893208 - protein, 483 aa, Homo sapiens; identical to SEQ ID NO: 893204

SEQ ID NO: 893209 - protein, 483 aa, Homo sapiens; identical to SEQ ID NO: 893204

SEQ ID NO: 893210 - protein, 463 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRR

SEQ ID NO: 893211 - protein, 387 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNGAWAVTTLPIWEALTPLDTMGGF

SEQ ID NO: 893212 - protein, 147 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVGIQDSEFPTKQQNVLSSIPEIK

SEQ ID NO: 893213 - protein, 483 aa, Homo sapiens; identical to SEQ ID NO: 893204

SEQ ID NO: 893214 - protein, 483 aa, Homo sapiens; identical to SEQ ID NO: 893204

SEQ ID NO: 893215 - protein, 483 aa, Homo sapiens; identical to SEQ ID NO: 893204

SEQ ID NO: 893216 - protein, 402 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREL

SEQ ID NO: 893217 - protein, 286 aa, Homo sapiens
PEDGPLSLPPYPSLPIAPIPINDNLPLISPASRKSANNIESRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 893218 - protein, 483 aa, Homo sapiens; identical to SEQ ID NO: 893204

SEQ ID NO: 893219 - protein, 298 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSKSCLLRNLSWISMPSQNT

SEQ ID NO: 893220 - protein, 69 aa, Homo sapiens
MKAFHTFCVVLLVFGSVSEAKFDDFEDEEDIVEYDDNDFAEFEDVMEDSVTESPQRVIITEDDEDETTV

SEQ ID NO: 893221 - protein, 1139 aa, Homo sapiens
AAAAPGCALSRRPPERHGRSCGGGIMAPTLLQKLFNKRGSSGSSAAASAQGRAPKEGPAFSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVHHPVLDEPIAEAVCIIADTDKWSVQVATSQRKVTDNMKLGQDVLVSSQVSSLLQSILQLYKLHLPADFCIMHLEDRLQEMYLKSKMLSEYLRGHTRVHVKELGVVLGIESNDLPLLTAIASTHSPYVAQILL

SEQ ID NO: 893222 - protein, 1188 aa, Homo sapiens
AFLTYCIGSEMMFRTAGHYRMFLTEQRNFRIVSKSMFMVRINQKNIKPVQEMCGGTANTTNQPESWQDSARCVSDAVPGAGRIYRALLCTKIKKHTGVDRSTDHTELDNSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVHHPVLDEPIAEAVCIIADTDKWSVQVATSQRKVTDNMKLGQDVLVSSQVSSLLQSILQLYKLHLPADFCIMHLEDRLQEMYLKSKMLSEYLRGHTRVHVKELGVVLGIESNDLPLLTAIASTHSPYVAQILL

SEQ ID NO: 893223 - protein, 1169 aa, Homo sapiens
AAAAPGCALSRRPPERHGRSCGGGIMAPTLLQKLFNKRGSSGSSAAASAQGRAPKEGPAFSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLGLLQACSSKLLQGVAEGGPLRLTRSASFFAAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVHHPVLDEPIAEAVCIIADTDKWSVQVATSQRKVTDNMKLGQDVLVSSQVSSLLQSILQLYKLHLPADFCIMHLEDRLQEMYLKSKMLSEYLRGHTRVHVKELGVVLGIESNDLPLLTAIASTHSPYVAQILL

SEQ ID NO: 893224 - protein, 1008 aa, Homo sapiens
AAAAPGCALSRRPPERHGRSCGGGIMAPTLLQKLFNKRGSSGSSAAASAQGRAPKEGPAFSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVH

SEQ ID NO: 893225 - protein, 98 aa, Homo sapiens
PTQGCCYGAGRPCGAAARPTNVAQGGFLGGGVRGWSRARASAAGRAAASRRSSVLPGLPDPKLCPRPAQRAWAGGAGGGDGQRGTPRIGRGRSYWSQV

SEQ ID NO: 893226 - protein, 240 aa, Homo sapiens
RRKAAAMGPGGRVARLLAPLMWRRAVSSVAGSAVGAEPGLRLLAVQRLPVGAAFCRACQTPNFVRGLHSEPGLEERAEGTVNEGRPESDAADHTGPKFDIDMMVSLLRQENARDICVIQVPPEMRYTDYFVIVSGTSTRHLHAMAFYVVKMYKHLKCKRDPHVKIEGKDTDDWLCVDFGSMVIHLMLPETREIYELEKLWTLRSYDDQLAQIAPETVPEDFILGIEDDTSSVTPVELKCE

SEQ ID NO: 893227 - protein, 240 aa, Homo sapiens; identical to SEQ ID NO: 893226

SEQ ID NO: 893228 - protein, 113 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPPHYQPDQFAC

SEQ ID NO: 893229 - protein, 113 aa, Homo sapiens; identical to SEQ ID NO: 893228

SEQ ID NO: 893230 - protein, 77 aa, Homo sapiens
GDEVACPKSYEPLEEATLSELKTVLKSFLSQGQVLKLEAKTDPSILGGMIVRIGEKYVDMSVKTKIQKLGRAMREIV

SEQ ID NO: 893231 - protein, 113 aa, Homo sapiens; identical to SEQ ID NO: 893228

SEQ ID NO: 893232 - protein, 128 aa, Homo sapiens
PREPSGYANARVRPCAFLSSHSGLTYSRPGEDGCPSSVRALPAGERKVVLRASGRIPPGMTGTKPRAPGCDASAGEVWQSSRLWDLASGSDSGRPSVCPPGCLRGSRRGAARAVTLASSEHSPWKLLA

SEQ ID NO: 893233 - protein, 129 aa, Homo sapiens
RERERERERERERERERERAAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPPHYQPDQFAC

SEQ ID NO: 893234 - protein, 113 aa, Homo sapiens; identical to SEQ ID NO: 893228

SEQ ID NO: 893235 - protein, 113 aa, Homo sapiens; identical to SEQ ID NO: 893228

SEQ ID NO: 893236 - protein, 113 aa, Homo sapiens; identical to SEQ ID NO: 893228

SEQ ID NO: 893237 - protein, 113 aa, Homo sapiens; identical to SEQ ID NO: 893228

SEQ ID NO: 893238 - protein, 128 aa, Homo sapiens; identical to SEQ ID NO: 893232

SEQ ID NO: 893239 - protein, 113 aa, Homo sapiens; identical to SEQ ID NO: 893228

SEQ ID NO: 893240 - protein, 113 aa, Homo sapiens; identical to SEQ ID NO: 893228

SEQ ID NO: 893241 - protein, 113 aa, Homo sapiens; identical to SEQ ID NO: 893228

SEQ ID NO: 893242 - protein, 113 aa, Homo sapiens; identical to SEQ ID NO: 893228

SEQ ID NO: 893243 - protein, 196 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPPHYQPDHFSTMMSVHRGEVPCTVTSASPLEEATLSELKTVLKSFLSQGQVLKLEAKTDPSILGGMIVRIGEKYVDMSVKTKIQKLGRAMREIV

SEQ ID NO: 893244 - protein, 68 aa, Homo sapiens
PREPSGYANARVRPCAFLSSHSGLTYSRPGEDGCPSSVRALPAGAMLQYLCGQTICQACEASCSGIRY

SEQ ID NO: 893245 - protein, 113 aa, Homo sapiens; identical to SEQ ID NO: 893228

SEQ ID NO: 893246 - protein, 68 aa, Homo sapiens; identical to SEQ ID NO: 893244

SEQ ID NO: 893247 - protein, 113 aa, Homo sapiens; identical to SEQ ID NO: 893228

SEQ ID NO: 893248 - protein, 113 aa, Homo sapiens; identical to SEQ ID NO: 893228

SEQ ID NO: 893249 - protein, 68 aa, Homo sapiens; identical to SEQ ID NO: 893244

SEQ ID NO: 893250 - protein, 102 aa, Homo sapiens
SRPGEDGCPSSVRALPAGERKVVLRASGRIPPGMTGTKPRAPGCDASAGEVWQSSRLWDLASGSDSGRPSVCPPGCLRGSRRGAARAVTLASSEHSPWKLLA

SEQ ID NO: 893251 - protein, 361 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 893252 - protein, 361 aa, Homo sapiens; identical to SEQ ID NO: 893251

SEQ ID NO: 893253 - protein, 200 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRYIYQFLEKIVETTLRNLLNISTSYSFMEVA

SEQ ID NO: 893254 - protein, 361 aa, Homo sapiens; identical to SEQ ID NO: 893251

SEQ ID NO: 893255 - protein, 446 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVMGETHVKPHPVLRGKAKNPGHSDEVDGQACVLWGSSMEQGAMSYKYRMLTDCATGATPCHDVPVTFQLEFQTLKFLKPPSNEFEVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 893256 - protein, 361 aa, Homo sapiens; identical to SEQ ID NO: 893251

SEQ ID NO: 893257 - protein, 361 aa, Homo sapiens; identical to SEQ ID NO: 893251

SEQ ID NO: 893258 - protein, 211 aa, Homo sapiens
MLLDVCCMSHKGTKQIRCARIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 893259 - protein, 134 aa, Homo sapiens [sequence omitted]

SEQ ID NO: 893260 - protein, 117 aa, Homo sapiens
MEQVTMLSSWFPLSEELLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 893261 - protein, 186 aa, Homo sapiens
SVPTTGVLYGGSGDGFQGTWLHTSGHPDRRDDFLLLCPQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 893262 - protein, 141 aa, Homo sapiens
SGGGGRSAGASGGRGERGPGRDATQRDNAESLSGVRSPGRALVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 893263 - protein, 140 aa, Homo sapiens
MRQVLRPVFQVLTGALGAHRREYGSAATGTVHLPVCQAQSMDKPHSRAVHPGTMHGQQESRPADAKRAYCQGKVPAPAHSLWILGLWGLSWRVSLWFVSGLQWWLTPLVRKHSWEVFCGSKHVAPIITGEQKALDTPFGM

SEQ ID NO: 893264 - protein, 361 aa, Homo sapiens; identical to SEQ ID NO: 893251

SEQ ID NO: 893265 - protein, 361 aa, Homo sapiens; identical to SEQ ID NO: 893251

SEQ ID NO: 893266 - protein, 361 aa, Homo sapiens; identical to SEQ ID NO: 893251

SEQ ID NO: 893267 - protein, 361 aa, Homo sapiens; identical to SEQ ID NO: 893251

SEQ ID NO: 893268 - protein, 361 aa, Homo sapiens; identical to SEQ ID NO: 893251

SEQ ID NO: 893269 - protein, 140 aa, Homo sapiens; identical to SEQ ID NO: 893263

SEQ ID NO: 893270 - protein, 140 aa, Homo sapiens; identical to SEQ ID NO: 893263

SEQ ID NO: 893271 - protein, 140 aa, Homo sapiens; identical to SEQ ID NO: 893263

SEQ ID NO: 893272 - protein, 85 aa, Homo sapiens
PGLQEFGTSPRSCTLSMDTWVVGALLESKFVVCFWFTVVADTPCKKAFLGSLLWVQTCCSDHHRRAKGPRYPLWNVRVLLSDICH

SEQ ID NO: 893273 - protein, 339 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELTQQPQFGQPLSPTS

SEQ ID NO: 893274 - protein, 70 aa, Homo sapiens
FLPVPGCYLLPVPGYYLLSISGHHLIPIPCVHLHLIIRSPGCHIPNLLVSGARAQAGLWNVRVLLSDICH

SEQ ID NO: 893275 - protein, 368 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELVRAWQSWRVHPLGPCAGDKADSGRGVGDDGGEEGCVDQLPAMS

SEQ ID NO: 893276 - protein, 250 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTEK

SEQ ID NO: 893277 - protein, 177 aa, Homo sapiens
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRSTARICS

SEQ ID NO: 893278 - protein, 103 aa, Homo sapiens [sequence omitted]

SEQ ID NO: 893279 - protein, 103 aa, Homo sapiens [sequence omitted]

SEQ ID NO: 893280 - protein, 494 aa, Homo sapiens
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIERSLILLECSGMVSAHCSLHLPGSSDSPASAS

SEQ ID NO: 893281 - protein, 185 aa, Homo sapiens
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKETSQSRRTFPRLESYIPNAPGVRRAPGWSQSGGAPWFPSFLSLSCGRLPVGPSSVNPGPRRTPPSEGDSPAKPEKVRNSEDRNT

SEQ ID NO: 893282 - protein, 504 aa, Homo sapiens
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 893283 - protein, 385 aa, Homo sapiens
MLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 893284 - protein, 504 aa, Homo sapiens; identical to SEQ ID NO: 893282

SEQ ID NO: 893285 - protein, 385 aa, Homo sapiens; identical to SEQ ID NO: 893283

SEQ ID NO: 893286 - protein, 385 aa, Homo sapiens; identical to SEQ ID NO: 893283

SEQ ID NO: 893287 - protein, 265 aa, Homo sapiens
MAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 893288 - protein, 265 aa, Homo sapiens; identical to SEQ ID NO: 893287

SEQ ID NO: 893289 - protein, 504 aa, Homo sapiens; identical to SEQ ID NO: 893282

SEQ ID NO: 893290 - protein, 504 aa, Homo sapiens; identical to SEQ ID NO: 893282

SEQ ID NO: 893291 - protein, 219 aa, Homo sapiens [sequence omitted]

SEQ ID NO: 893292 - protein, 481 aa, Homo sapiens
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIDSLGDRVRHHLKKKKKKKM

SEQ ID NO: 893293 - protein, 180 aa, Homo sapiens
GKEICHRNISRDLNSFLEDRDYIFLISLFWEPKHTLHTVIQFCSTGLLLLSAVCQHSARRFSSIRVYKWMNGFDSCASISQPLYVTFHAGGFQCVLWMAGLKRRVPLHSLRYFISMVGLFSKPGLLPWYARNPPGWSQLFLGTVCKGDFTRVIATKCQKGQKSQKKPSHLGPLDGSWQER

SEQ ID NO: 893294 - protein, 280 aa, Homo sapiens
MLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRFFKDTFPRLTLFVPDSRIPNGEERNEETETTAEKLNRTATRRIGEKQPEHGHMSPTEATRRSIGTSSRSPSKRERRQSKPGEAD

SEQ ID NO: 893295 - protein, 504 aa, Homo sapiens; identical to SEQ ID NO: 893282

SEQ ID NO: 893296 - protein, 265 aa, Homo sapiens; identical to SEQ ID NO: 893287

SEQ ID NO: 893297 - protein, 385 aa, Homo sapiens; identical to SEQ ID NO: 893283

SEQ ID NO: 893298 - protein, 473 aa, Homo sapiens
DPRVGTHAYGRLRLVRGFIRLQKEKVDFSVFFGWQALREESHCTASDTSSPWLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 893299 - protein, 265 aa, Homo sapiens; identical to SEQ ID NO: 893287

SEQ ID NO: 893300 - protein, 265 aa, Homo sapiens; identical to SEQ ID NO: 893287

SEQ ID NO: 893301 - protein, 219 aa, Homo sapiens [sequence omitted]

SEQ ID NO: 893302 - protein, 496 aa, Homo sapiens
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEELHVQKEIVKEFFIRGPGAACGLTSLYFQESTMTRCSHQQSPYQLLFGEPYIFEELLSLKIRISPDAFFQINTAGAEMLYRTVGELTGVNSDTILLDICCGTGVIGLSLAQHTSRVLGIELLEQAVEDARWTAAFNGITNSEFHTGQAEKILPGLLKSKEDGQSIVAVVNPARAGLHYKVIQAIRNFRAIHTLVFVSCKLHGESTRNVIERSLILLECSGMVSAHCSLHLPGESLEPGGRRLQ

SEQ ID NO: 893303 - protein, 139 aa, Homo sapiens
FLLLPRPASPASCFCRFLLLLLPASAKWLLPASGQAEKILPGLLKSKEDGQSIVAVVNPARAGLHYKVIQAIRNFRAIHTLVFVSCKLHGESTRNVIELCCPPDPAKKLLGEPFVLQQAVPVDLFPHTPHCELVLLFTR

SEQ ID NO: 893304 - protein, 854 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 893305 - protein, 934 aa, Homo sapiens
ANSETHIRNWKKRKAKRKKKDRKLRKNGEKERGSVKGNEKGEIVTGIEKGAQIVIRIAVDQEKKAEIVKGNESGKERERENESENENGSERESEEREREREKKKKKTEAEEQETGSLEESTDESEEEESEEEPKLKYERLSNGVTEILQKDAASCMTVHDKFLALGTHYGKVYLLDVQGNITQKFDVVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 893306 - protein, 854 aa, Homo sapiens; identical to SEQ ID NO: 893304

SEQ ID NO: 893307 - protein, 854 aa, Homo sapiens; identical to SEQ ID NO: 893304

SEQ ID NO: 893308 - protein, 469 aa, Homo sapiens
LWGKCLLILSLFVFCFFNIYFLSAWDVFTASKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 893309 - protein, 192 aa, Homo sapiens [sequence omitted]

SEQ ID NO: 893310 - protein, 192 aa, Homo sapiens [sequence omitted]

SEQ ID NO: 893311 - protein, 192 aa, Homo sapiens [sequence omitted]

SEQ ID NO: 893312 - protein, 854 aa, Homo sapiens; identical to SEQ ID NO: 893304

SEQ ID NO: 893313 - protein, 802 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSE

SEQ ID NO: 893314 - protein, 873 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMVGTARIHLYMDFLLPLPPLRRQDQALPFLLLLSLLSMKTTEMKHL

SEQ ID NO: 893315 - protein, 826 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAENNGTGKSCLLEKKLIPTISLA

SEQ ID NO: 893316 - protein, 776 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQQLLFFRMLVTSIELELKHFLKNS

SEQ ID NO: 893317 - protein, 517 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAEL

SEQ ID NO: 893318 - protein, 415 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLDSEVRRGSSI

SEQ ID NO: 893319 - protein, 269 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSADPVVK

SEQ ID NO: 893320 - protein, 158 aa, Homo sapiens
MAEAVEQETGSLEESTDESEEEESEEEPKLKYERLSNGVTEILQKDAASCMTVHDKFLALGTHYGKVYLLDVQGNITQKFDVSPVKINQISLDESGEHMGVCSEDGKVQVFGLYSGEEFHETFDCPIKIIAVHPHFVRSSCKQFVTGGKKVSAVCLLP

SEQ ID NO: 893321 - protein, 198 aa, Homo sapiens
MDAILNYRSEDTEDYYTLLGCDELSSVEQILAEFKVRALECHPDKHPENPKAVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 893322 - protein, 198 aa, Homo sapiens; identical to SEQ ID NO: 893321

SEQ ID NO: 893323 - protein, 198 aa, Homo sapiens; identical to SEQ ID NO: 893321

SEQ ID NO: 893324 - protein, 208 aa, Homo sapiens
MNYLRLNKSWQNLKSELWNVTQTSILKTPKLVDPGVKSECLARLPASFAPISLQNEISLPRTVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 893325 - protein, 107 aa, Homo sapiens
MDAILNYRSEDTEDYYTLLGCDELSSVEQILAEFKVRALECHPDKHPENPKAVETFQKLQKAKEILTNEESRARYDHWRRSQMSMPFQQWEALNDSVKTVGFSLGAT

SEQ ID NO: 893326 - protein, 107 aa, Homo sapiens; identical to SEQ ID NO: 893325

SEQ ID NO: 893327 - protein, 293 aa, Homo sapiens [sequence omitted]

SEQ ID NO: 893328 - protein, 316 aa, Homo sapiens
LRTSCWSTEPQGVFKTEQYYTSSASWCGLSRWQRGRPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 893329 - protein, 293 aa, Homo sapiens [sequence omitted]

SEQ ID NO: 893330 - protein, 293 aa, Homo sapiens [sequence omitted]

SEQ ID NO: 893331 - protein, 293 aa, Homo sapiens [sequence omitted]

SEQ ID NO: 893332 - protein, 285 aa, Homo sapiens [sequence omitted]

SEQ ID NO: 893333 - protein, 265 aa, Homo sapiens
SLTTFDAISKTYSYLPPDLWKETVCKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 893334 - protein, 184 aa, Homo sapiens
MPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 893335 - protein, 262 aa, Homo sapiens
MTPVQRGGPGALVALGWGTAVASAEVSAVASGAGVAAVDGAGAEAAELAEARPRIRIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 893336 - protein, 102 aa, Homo sapiens
MADDAGAAGGPGGPGGPGMGNRGGFRGGFGSGIRGRGRGRGRGRGRGRGARGGKAEDKEWMPVTKLGRLVKDMKIKSLEEIYLFSLPTPCPISDSLMGREKR

SEQ ID NO: 893337 - protein, 356 aa, Homo sapiens
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATSGRGGRGGARGERRGGRAAAPAPMVRYCSGAQGSTLSFPPGVPAPTAVSQRPSPSGPPPRCSVPGCPHPRRYACSRTGQALCSLQCYRINLQMRLGGPEGPGSPLLAT

SEQ ID NO: 893338 - protein, 356 aa, Homo sapiens; identical to SEQ ID NO: 893337

SEQ ID NO: 893339 - protein, 356 aa, Homo sapiens; identical to SEQ ID NO: 893337

SEQ ID NO: 893340 - protein, 255 aa, Homo sapiens
MVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATSGRGGRGGARGERRGGRAAAPAPMVRYCSGAQGSTLSFPPGVPAPTAVSQRPSPSGPPPRCSVPGCPHPRRYACSRTGQALCSLQCYRINLQMRLGGPEGPGSPLLAT

SEQ ID NO: 893341 - protein, 255 aa, Homo sapiens; identical to SEQ ID NO: 893340

SEQ ID NO: 893342 - protein, 280 aa, Homo sapiens
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATSGRGGRGGARGERRGGRAAAPAPMVPPSHARS

SEQ ID NO: 893343 - protein, 194 aa, Homo sapiens
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLRPAAALLCPRLSPSAPLRLLPHRPGTL

SEQ ID NO: 893344 - protein, 194 aa, Homo sapiens; identical to SEQ ID NO: 893343

SEQ ID NO: 893345 - protein, 105 aa, Homo sapiens
MVVDNEEEPMEGVPLEQYRAWLDEDSNLSPSPLRDLSGGLGGQEEEEEQRWLDALEKGELDDNGDLKKEINERLLTARQRALLQKARSQPSLGGPEGPGSPLLAT

SEQ ID NO: 893346 - protein, 168 aa, Homo sapiens
MTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILTEAEIDAHLVALAERD

SEQ ID NO: 893347 - protein, 145 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCKYAKRSPK

SEQ ID NO: 893348 - protein, 247 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILTEAEIDAHLVALAERD

SEQ ID NO: 893349 - protein, 296 aa, Homo sapiens
ERGIDWDTRHDMLDGYSCCPTVVNSGDVPIVLVCLISEPRYSVISRCTNMSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILTEAEIDAHLVALAERD

SEQ ID NO: 893350 - protein, 228 aa, Homo sapiens
MAGLRREYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILTEAEIDAHLVALAERD

SEQ ID NO: 893351 - protein, 247 aa, Homo sapiens; identical to SEQ ID NO: 893348

SEQ ID NO: 893352 - protein, 168 aa, Homo sapiens
MTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWETAITCLSTVLSIDFKPSEIEVGVVTVENPKFRILTEAEIDAHLVALAERD

SEQ ID NO: 893353 - protein, 253 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILSQFLLLETSSSSSCFFLFIVIF

SEQ ID NO: 893354 - protein, 249 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILSRSRNWKQELARSRNWSF

SEQ ID NO: 893355 - protein, 210 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKVSQPKGADFFYAI

SEQ ID NO: 893356 - protein, 197 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLGGDLMAIGTAGAALLPGS

SEQ ID NO: 893357 - protein, 67 aa, Homo sapiens
NSQIVNAQSTSTLKQPVTAITCLSTVLSIDFKPSEIEVGVVTVENPKFRILTEAEIDAHLVALAERD

SEQ ID NO: 893358 - protein, 197 aa, Homo sapiens
GLASALCWGGPFRRGGSGMAPRKIGDRLKKYEAAYGKQFTPCQLLADHATSPNKKFYQLSRPHASLSQCTNPRGGQGWFSNRVGEMRPLGGGMILIGIDEEQGPQVYKCDPAGYYCGFKATAAGVKQTESTSFLEKTSERRNLIGHLNRQWKTAITCLSTVLSIDFKPSEIEVGVVTVENPKFRILSRSRNWPVPAS

SEQ ID NO: 893359 - protein, 162 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCV

SEQ ID NO: 893360 - protein, 247 aa, Homo sapiens; identical to SEQ ID NO: 893348

SEQ ID NO: 893361 - protein, 247 aa, Homo sapiens; identical to SEQ ID NO: 893348

SEQ ID NO: 893362 - protein, 168 aa, Homo sapiens; identical to SEQ ID NO: 893346

SEQ ID NO: 893363 - protein, 247 aa, Homo sapiens; identical to SEQ ID NO: 893348

SEQ ID NO: 893364 - protein, 242 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKTSERRNLIGHLNRQWKTAITCLSTVLSIDFKPSEIEVGVVTVENPKFRILSRSRNWPVPAS

SEQ ID NO: 893365 - protein, 110 aa, Homo sapiens
MILIGIDEEQGPQVYKCDPAGYYCGFKATAAGVKQTESTSFLEKTSERRNLIGHLNRQWKTAITCLSTVLSIDFKPSEIEVGVVTVENPKFRILTEAEIDAHLVALAERD

SEQ ID NO: 893366 - protein, 191 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLDCNYMPVYCSIN

SEQ ID NO: 893367 - protein, 200 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQTAITCLSTVLSIDFKPSEIEVGVVTVENPKFRILTEAEIDAHLVALAERD

SEQ ID NO: 893368 - protein, 491 aa, Homo sapiens [sequence omitted]

SEQ ID NO: 893369 - protein, 491 aa, Homo sapiens [sequence omitted]

SEQ ID NO: 893370 - protein, 540 aa, Homo sapiens
GPSGLPGAGARGSGLGAWASPASACPSLKRGLLAWSWDQLGNGPGDPQWRVSGAFPRASPARSPLPGQVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 893371 - protein, 491 aa, Homo sapiens [sequence omitted]

SEQ ID NO: 893372 - protein, 454 aa, Homo sapiens
MSVSIEDTPGRNEEVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 893373 - protein, 476 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVTILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 893374 - protein, 124 aa, Homo sapiens
MKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 893375 - protein, 491 aa, Homo sapiens [sequence omitted]

SEQ ID NO: 893376 - protein, 491 aa, Homo sapiens [sequence omitted]

SEQ ID NO: 893377 - protein, 491 aa, Homo sapiens [sequence omitted]

SEQ ID NO: 893378 - protein, 491 aa, Homo sapiens [sequence omitted]

SEQ ID NO: 893379 - protein, 464 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQVCIYADWFF

SEQ ID NO: 893380 - protein, 368 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEVCVLY

SEQ ID NO: 893381 - protein, 422 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGELTFLPREPHFA

SEQ ID NO: 893382 - protein, 368 aa, Homo sapiens; identical to SEQ ID NO: 893380

SEQ ID NO: 893383 - protein, 368 aa, Homo sapiens; identical to SEQ ID NO: 893380

SEQ ID NO: 893384 - protein, 248 aa, Homo sapiens [sequence omitted]

SEQ ID NO: 893385 - protein, 162 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIEVNCFFNSYLTLIE

SEQ ID NO: 893386 - protein, 240 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVTILVQSWYPITVATNSREQKKILAKYLLETSGNLDGLEYKLHDFGYRGVSSQETAGIGASAHLVNFKGTDTVAGLALIKKYYGTKDPVPGYSVPAAEHSRISILWI

SEQ ID NO: 893387 - protein, 123 aa, Homo sapiens
VELQLQAPWGCTKLLNLTCFLKFCCLPLGRWVQQETLEHQMEKLFLPSPLPVHQKECIRNSRSEHLGFLRVRQCGAPVGRWVLYPVWPPAPTAFQLWGFSLWKLLSKFDFSICKRRQVRVGMT

SEQ ID NO: 893388 - protein, 491 aa, Homo sapiens [sequence omitted]

SEQ ID NO: 893389 - protein, 491 aa, Homo sapiens [sequence omitted]

SEQ ID NO: 893390 - protein, 470 aa, Homo sapiens
MNPAAEAEFNILLATDSYKVTHYKQYPPNTSKVYSYFECREKKTENSKLRSKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 893391 - protein, 124 aa, Homo sapiens; identical to SEQ ID NO: 893374

SEQ ID NO: 893392 - protein, 473 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 893393 - protein, 124 aa, Homo sapiens; identical to SEQ ID NO: 893374

SEQ ID NO: 893394 - protein, 137 aa, Homo sapiens
MTSALTQGLERIPDQLGYLVLSEGAVLASSGDLENDEQAASAISELVSTACGFRLHRGMNVPFKRLSGEPLPLPLVVVLGAGGYFQGLLGFSSSSLLPSPGVSGLATFLPLGLPGIRIVNEKARERRSSRGHSSSNL

SEQ ID NO: 893395 - protein, 164 aa, Homo sapiens
LQESSAFLRDLNPQGIRLPLPVPHCQTPRSEVMPPGYQTDLLEARELIEKLDSMSSLVSSGRLAMTTSALTQGLERIPDQLGYLVLSEGAVLASSGDLENDEQAASAISELVSTACGFRLHRGMNVPFKRLSVVFGEHTLLVTVSGQRVFVVKRQNRGREPIDV

SEQ ID NO: 893396 - protein, 114 aa, Homo sapiens
RAPPSPKIRLGTRLGGTSALTQGLERIPDQLGYLVLSEGAVLASSGDLENDEQAASAISELVSTACGFRLHRGMNVPFKRLSVVFGEHTLLVTVSGQRVFVVKRQNRGREPIDV

SEQ ID NO: 893397 - protein, 136 aa, Homo sapiens
MTSALTQGLERIPDQLGYLVLSEGAVLAVRSGKGRGSLSAHSPVTPSNIGPSFLGFYLVSCLASIRLVQKYLQFLQLLSVISLWNLILLTAAIYLFIVFETEFRSCCPSWSAVVRPRLTATSASGVQAILLPQPPE

SEQ ID NO: 893398 - protein, 135 aa, Homo sapiens
MNVPFKRLSVVFGEHTLLVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 893399 - protein, 125 aa, Homo sapiens
MVSEDACARGPAGGSASLLPSLCGFPLTSALTQGLERIPDQLGYLVLSEGAVLASSGDLENDEQAASAISELVSTACGFRLHRGMNVPFKRLSVVFGEHTLLVTVSGQRVFVVKRQNRGREPIDV

SEQ ID NO: 893400 - protein, 125 aa, Homo sapiens; identical to SEQ ID NO: 893399

SEQ ID NO: 893401 - protein, 193 aa, Homo sapiens
MTSALTQGLERIPDQLGYLVLSEGAVLASSGDLENDEQAASAISELVSTACGFRLHRGMNVPFKRLSVVFGEHTLLVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 893402 - protein, 617 aa, Homo sapiens
SEKTPNGGYKPKLNTLKLYRLLPMRAAKRPYKTYSQGAPEAPLSPTLNTPAPVAMPASPPPGPPPAPEPGPPPSVITFAHPAPSVIVHGGSSSGGGGSGTASTGGSQAASVITYTAPPRPPKKREYPPPPPEPAATPTSPATAVSPATAAGPAMATTTEEAKGRNPRAGRTLTYTAKPVGGIGGGGGPPTGAGRGPSQLQAPPPLCQITVRIGEEAIVKRRISETDLRPGELSGEEMEESEEDEEEEDEEEEEEDEEESKAGGEDQLWRPYYSYKPKRKAGAAGGASVGGSGLPRGRRPPRWRQKLERRSWEETPAAESPAGRARTERRHRCGDCAQTFTTLRKLRKHQEAHGGGSHSSRAGRRPSTRFTCPHCAKVCKTAAALSRHGQRHAAERPGGTPTPVIAYSKGSAGTRPGDVKEEAPQEMQVSSSSGEAGGGSTAAEEASETASLQDPIISGGEEPPVVASGGSYVYPPVQEFPLALIGGGREPGGGRGKSGSEGPVGAGEGDRMEGIGAAKVTFYPEPYPLVYGPQLLAAYPYNFSNLAALPVALNMVLPDEKGAGALPFLPGVFGYAVNPQAAPPAPPTPPPPTLPPPIPPKGEGERAGVERTQKGDVG

SEQ ID NO: 893403 - protein, 617 aa, Homo sapiens; identical to SEQ ID NO: 893402

SEQ ID NO: 893404 - protein, 617 aa, Homo sapiens; identical to SEQ ID NO: 893402

SEQ ID NO: 893405 - protein, 617 aa, Homo sapiens; identical to SEQ ID NO: 893402

SEQ ID NO: 893406 - protein, 617 aa, Homo sapiens; identical to SEQ ID NO: 893402

SEQ ID NO: 893407 - protein, 617 aa, Homo sapiens; identical to SEQ ID NO: 893402

SEQ ID NO: 893408 - protein, 617 aa, Homo sapiens; identical to SEQ ID NO: 893402

SEQ ID NO: 893409 - protein, 617 aa, Homo sapiens; identical to SEQ ID NO: 893402

SEQ ID NO: 893410 - protein, 416 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQMCSDFNRVAGSSTRAHYHSGGADFPRPGLVVSSVY

SEQ ID NO: 893411 - protein, 118 aa, Homo sapiens
MTVLKIPAYLEALILCSCTLACIVVVVQTFRDLVWLCPQCTEAVCQALPGCEENIQDSEVDCNSPLLLGRGRMLETLPFEMESNYSLYPVFEVGTLRIDCHLRFSFGYRWHINYKNKI

SEQ ID NO: 893412 - protein, 416 aa, Homo sapiens; identical to SEQ ID NO: 893410

SEQ ID NO: 893413 - protein, 416 aa, Homo sapiens; identical to SEQ ID NO: 893410

SEQ ID NO: 893414 - protein, 510 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIGGFFRRK

SEQ ID NO: 893415 - protein, 341 aa, Homo sapiens
MPYLGSEDVVKELKKALCNPHIQADRLRYRNVIQRVIRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQMCSDFNRVAGSSTRAHYHSGGADFPRPGLVVSSVY

SEQ ID NO: 893416 - protein, 282 aa, Homo sapiens
MVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQ

SEQ ID NO: 893417 - protein, 366 aa, Homo sapiens
YGYYEAGVNRPRVSKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQMCSDFNRVAGSSTRAHYHSGGADFPRPGLVVSSVY

SEQ ID NO: 893418 - protein, 615 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGKNSPYLKSCHDKSLPFQ

SEQ ID NO: 893419 - protein, 69 aa, Homo sapiens
ARFGSTYTKIGTIQRRLAWPLRKDDTQIREAFQYFCSDFNRVAGSSTRAHYHSGGADFPRPGLVVSSVY

SEQ ID NO: 893420 - protein, 385 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIDFFIVPCLEFERLE

SEQ ID NO: 893421 - protein, 301 aa, Homo sapiens
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 893422 - protein, 301 aa, Homo sapiens; identical to SEQ ID NO: 893421

SEQ ID NO: 893423 - protein, 301 aa, Homo sapiens; identical to SEQ ID NO: 893421

SEQ ID NO: 893424 - protein, 362 aa, Homo sapiens
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKEEMRLCHVGQAGLELLTSSDPLVSASQSARITGVSHRARPILTVITVFSFHIYAHLLVRLQMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 893425 - protein, 183 aa, Homo sapiens [sequence omitted]

SEQ ID NO: 893426 - protein, 124 aa, Homo sapiens
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKKSWAIL

SEQ ID NO: 893427 - protein, 204 aa, Homo sapiens
MGAVTDDEVIRKRLLIDGDGAGDDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 893428 - protein, 152 aa, Homo sapiens
MLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 893429 - protein, 222 aa, Homo sapiens
SGTAASACAAAAAAAAHAMGAVTDDEVIRKRLLIDGDGAGDDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 893430 - protein, 204 aa, Homo sapiens; identical to SEQ ID NO: 893427

SEQ ID NO: 893431 - protein, 204 aa, Homo sapiens; identical to SEQ ID NO: 893427

SEQ ID NO: 893432 - protein, 152 aa, Homo sapiens; identical to SEQ ID NO: 893428

SEQ ID NO: 893433 - protein, 225 aa, Homo sapiens
RPPPGSTGSAGSAGPAAAAHAMGAVTDDEVIRKRLLIDGDGAGDDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 893434 - protein, 216 aa, Homo sapiens
DPDCGRPAAPAAPPQPWRHEVIRKRLLIDGDGAGDDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMETDPKP

SEQ ID NO: 893435 - protein, 204 aa, Homo sapiens; identical to SEQ ID NO: 893427

SEQ ID NO: 893436 - protein, 152 aa, Homo sapiens; identical to SEQ ID NO: 893428

SEQ ID NO: 893437 - protein, 302 aa, Homo sapiens
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSGLEQAHAMPSPRILKTHLPFHLLPPSLLEKNCKIIYVARNPKDNMVSYYHFQRMNKALPAPGTWEEYFETFLAGKVCWGSWHEHVKGWWEAKDKHRILYLFYEDMKKNPKHEIQKLAEFIGKKLDDKVLDKIVHYTSFDVMKQNPMANYSSIPAEIMDHSISPFMRKGAVGDWKKHFTVAQNERFDEDYKKKMTDTRLTFHFQF

SEQ ID NO: 893438 - protein, 102 aa, Homo sapiens
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSGEYK

SEQ ID NO: 893439 - protein, 227 aa, Homo sapiens
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSVCWGSWHEHVKGWWEAKDKHRILYLFYEDMKKNPKHEIQKLAEFIGKKLDDKVLDKIVHYTSFDVMKQNPMANYSSIPAEIMDHSISPFMRKGAVGDWKKHFTVAQNERFDEDYKKKMTDTRLTFHFQF

SEQ ID NO: 893440 - protein, 67 aa, Homo sapiens
PKHEIQKLAEFIGKKLDDKVLDKIVHYTSFDVMKQNPMANYSSIPAEIMDHSISPFMRKGFYSLFSL

SEQ ID NO: 893441 - protein, 80 aa, Homo sapiens
EVEPFLLTAASSLLLSLPRRRVHWLFKLPVLLRGVKKAGCARRLCYKLQFLFGVLTEKNTRKDRQDQCHGPALLLSFLKR

SEQ ID NO: 893442 - protein, 512 aa, Homo sapiens
MRAAKGRRRPRGSAGRRRPSVALQSRDDLGCRDAAVAGPSFPRPARARPRLSPESGYHRRLGSAPSGLFRRPAWHAGAAAAAAAAAAAAAAAGAAAWEAPRFRRPGLRRPGPRSLSLDPAPASAPPSGPEPRPGLRLGLASSPGTRPATAAAASPDAPPACAATMERPEAGGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGEKNGGEPDDAELVRLSKRLVENAVLKAVQQYLEETQNKNKPGEGSSVKTEAADQNGNDNENNRK

SEQ ID NO: 893443 - protein, 519 aa, Homo sapiens
RFPAQLNAKLRKRAVNMVRFPRMHFFMPGFAPLTSRGSQQYRALTVPELTQQMFDAKNMMAACDPRHGRYLTVAAVFRGRMSMKEVDEQMLNVQNKNSSYFVEWIPNNVKPAVCDIPPRGLKMSATFIGNSTAIQELFKQHLRLGLASSPGTRPATAAAASPDAPPACAATMERPEAGGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGEKNGGEPDDAELVRLSKRLVENAVLKAVQQYLEETQNKNKPGEGSSVKTEAADQNGNDNENNRK

SEQ ID NO: 893444 - protein, 367 aa, Homo sapiens
MRAAKGRRRPRGSAGRRRPSVALQSRDDLGCRDAAVAGPSFPRPARARPRLSPESGYHRRLGSAPSGLFRRPAWHAGAAAAAAAAAAAAAAAGAAAWEAPRFRRPGLRRPGPRSLSLDPAPASAPPSGPEPRPGLRLGLASSPGTRPATAAAASPDAPPACAATMERPEAGGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAGSEKNRS

SEQ ID NO: 893445 - protein, 560 aa, Homo sapiens
MRAAKGRRRPRGSAGRRRPSVALQSRDDLGCRDAAVAGPSFPRPARARPRLSPESGYHRRLGSAPSGLFRRPAWHAGAAAAAAAAAAAAAAAGAAAWEAPRFRRPGLRRPGPRSLSLDPAPASAPPSGPEPRPGLRLGLASSPGTRPATAAAASPDAPPACAATMERPEAGGINSNECENVSRKKKMSEEFEANTMDSLVDMPFATVDIQDDCGITDEPQINLKRSQENEWVKSDQVKKRKKKRKDYQPNYFLSIPITNKEEEQVLREEGRWWTRSVGISPGCRFCFSNVCIWTSLQLFMECPSPQIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGKKPIGIRDLINEALHRETMGLKSKVKQIKELLLKPETQARIRRELFEGRLINNSNSANDVDFSTTLT

SEQ ID NO: 893446 - protein, 80 aa, Homo sapiens; identical to SEQ ID NO: 893441

SEQ ID NO: 893447 - protein, 141 aa, Homo sapiens
SSCRSSRFPKDHLSAVASIKALEPGVKKIDPDLYEKFISHRFGEEILYRIDLCSMLKKKQSNGYYHCESSIVIGKKPIGIRDLINEALHRETMGLKSKVKQIKELLLKPETQARIRRELFEGRLINNSNSANDVDFSTTLT

SEQ ID NO: 893448 - protein, 104 aa, Homo sapiens
MGQLCCFPFSRDEGKISELESSSSAVLQRYSKDIPSWSSGEKNGGEPDDAELVRLSKRLVENAVLKAVQQYLEETQNKNKPGEGSSVKTEAADQNGNDNENNRK

SEQ ID NO: 893449 - protein, 80 aa, Homo sapiens; identical to SEQ ID NO: 893441

SEQ ID NO: 893450 - protein, 80 aa, Homo sapiens; identical to SEQ ID NO: 893441

SEQ ID NO: 893451 - protein, 578 aa, Homo sapiens [sequence omitted]

SEQ ID NO: 893452 - protein, 119 aa, Homo sapiens
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWLKLVDYIPSSLPAQAA

SEQ ID NO: 893453 - protein, 69 aa, Homo sapiens
FKAVGCPPVRQRCSTRGGVLPTSRLPCWMIPLVCRLRECLELFGGRCRTVTSQSAARSRCLVLKSSLRP

SEQ ID NO: 893454 - protein, 204 aa, Homo sapiens [sequence omitted]

SEQ ID NO: 893455 - protein, 130 aa, Homo sapiens
NITLFIGGFVVKKKRKKKGLVGYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893456 - protein, 204 aa, Homo sapiens [sequence omitted]

SEQ ID NO: 893457 - protein, 578 aa, Homo sapiens [sequence omitted]

SEQ ID NO: 893458 - protein, 552 aa, Homo sapiens
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893459 - protein, 562 aa, Homo sapiens
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQVEACRLYTKFSARPSSIEAIPFVIEKIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893460 - protein, 566 aa, Homo sapiens
MVGPWEFTPLFFVPQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQVEACRLYTKFSARPSSIEAIPFVIEKAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893461 - protein, 392 aa, Homo sapiens [sequence omitted]

SEQ ID NO: 893462 - protein, 392 aa, Homo sapiens [sequence omitted]

SEQ ID NO: 893463 - protein, 496 aa, Homo sapiens
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893464 - protein, 324 aa, Homo sapiens
IELALICVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893465 - protein, 577 aa, Homo sapiens
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQVEACRLYTKFSARPSSIEAIPFVIEKAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQGRLLRGGDS

SEQ ID NO: 893466 - protein, 632 aa, Homo sapiens
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQVEACRLYTKFSARPSSIEAIPFVIEKAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQELPPHCTVKLDSRSQTWFHLSPSFACAVSAVMLCTHPPIFAVWSWLYASRPSSTVHSSMKPSFL

SEQ ID NO: 893467 - protein, 577 aa, Homo sapiens; identical to SEQ ID NO: 893465

SEQ ID NO: 893468 - protein, 229 aa, Homo sapiens
MFAKSVVFMQKNRKPSELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893469 - protein, 132 aa, Homo sapiens
PQPPPHQPPHPTPHHKNLRPLAKLYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 893470 - protein, 69 aa, Homo sapiens; identical to SEQ ID NO: 893453

SEQ ID NO: 893471 - protein, 110 aa, Homo sapiens
RCLLTEFSLLESLGDCWHLNRISDPGALWPAAQNQTRIPALGHPSEGGQNHHRCCCAADRYMLVQRAAPEMAVRTMCLRRKIRMEGCPSYLEGLGSLGLAWERSAAKWKI

SEQ ID NO: 893472 - protein, 110 aa, Homo sapiens; identical to SEQ ID NO: 893471

SEQ ID NO: 893473 - protein, 110 aa, Homo sapiens; identical to SEQ ID NO: 893471

SEQ ID NO: 893474 - protein, 683 aa, Homo sapiens
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 893475 - protein, 683 aa, Homo sapiens; identical to SEQ ID NO: 893474

SEQ ID NO: 893476 - protein, 683 aa, Homo sapiens; identical to SEQ ID NO: 893474

SEQ ID NO: 893477 - protein, 683 aa, Homo sapiens; identical to SEQ ID NO: 893474

SEQ ID NO: 893478 - protein, 683 aa, Homo sapiens; identical to SEQ ID NO: 893474

SEQ ID NO: 893479 - protein, 683 aa, Homo sapiens; identical to SEQ ID NO: 893474

SEQ ID NO: 893480 - protein, 683 aa, Homo sapiens; identical to SEQ ID NO: 893474

SEQ ID NO: 893481 - protein, 588 aa, Homo sapiens [sequence omitted]

SEQ ID NO: 893482 - protein, 533 aa, Homo sapiens [sequence omitted]

SEQ ID NO: 893483 - protein, 183 aa, Homo sapiens
GGGEERAAAQSKLSRAEPSWGRRAREAAAARSPGELAVAGPGARDAAAAAPGARSVSLSRRGTAAGMAHKARRLAWGSQHGGTPRAPPHAPPRGGTRSPTALPPRPLGALGLGMASSAGPRPVRVAGAVLEFGTGVTGGRVRQGSWRRPRPSPSRLTGGEIWSVPGKRGPADLEHPHPAACLS

SEQ ID NO: 893484 - protein, 610 aa, Homo sapiens
GGGEERAAAQSKLSRAEPSWGRRAREAAAARSPGGSAAGWECPSVLDEAGACTMSSCVSSQPSSNRAAPQDELGGRGSSSSESQKPCEALRGLSSLSIHLGMESFIVVTECEPGCAVDLGLARDRPLEADGQEVPLDSSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKGTKKKKKGLDSMTSTVAAGWLDRRV

SEQ ID NO: 893485 - protein, 594 aa, Homo sapiens
GGGEERAAAQSKLSRAEPSWGRRAREAAAARSPGGSAAGWECPSVLDEAGACTMSSCVSSQPSSNRAAPQDELGGRGSSSSESQKPCEALRGLSSLSIHLGMESFIVVTECEPGCAVDLGLARDRPLEADGQEVPLDSSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKQGSEDNLQGTDPPPVGEEEVLL

SEQ ID NO: 893486 - protein, 551 aa, Homo sapiens
GGGEERAAAQSKLSRAEPSWGRRAREAAAARSPGGSAAGWECPSVLDEAGACTMSSCVSSQPSSNRAAPQDELGGRGSSSSESQKPCEALRGLSSLSIHLGMESFIVVTECEPGCAVDLGLARDRPLEADGQEVPLDSSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 893487 - protein, 594 aa, Homo sapiens; identical to SEQ ID NO: 893485

SEQ ID NO: 893488 - protein, 326 aa, Homo sapiens
SRTSARYEAGCYENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 893489 - protein, 306 aa, Homo sapiens
MKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 893490 - protein, 641 aa, Homo sapiens
GGGEERAAAQSKLSRAEPSWGRRAREAAAARSPGGSAAGWECPSVLDEAGACTMSSCVSSQPSSNRAAPQDELGGRGSSSSESQKPCEALRGLSSLSIHLGMESFIVVTECEPGCAVDLGLARDRPLEADGQEVPLDSSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 893491 - protein, 594 aa, Homo sapiens; identical to SEQ ID NO: 893485

SEQ ID NO: 893492 - protein, 414 aa, Homo sapiens
GGGEERAAAQSKLSRAEPSWGRRAREAAAARSPGGSAAGWECPSVLDEAGACTMSSCVSSQPSSNRAAPQDELGGRGSSSSESQKPCEALRGLSSLSIHLGMESFIVVTECEPGCAVDLGLARDRPLEADGQEVPLDSSGSQARPHLSGRKLSLQERSQGGLAAGGSLDMNGRCICPSLPYSPVSSPQSSPRLPRRPTVESHHVSITGMQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 893493 - protein, 594 aa, Homo sapiens; identical to SEQ ID NO: 893485

SEQ ID NO: 893494 - protein, 136 aa, Homo sapiens [sequence omitted]

SEQ ID NO: 893495 - protein, 594 aa, Homo sapiens; identical to SEQ ID NO: 893485

SEQ ID NO: 893496 - protein, 594 aa, Homo sapiens; identical to SEQ ID NO: 893485

SEQ ID NO: 893497 - protein, 110 aa, Homo sapiens
ECWPACLEVPRLTTCILGQLLFKTFLCQKSFIVIFRTTSDIPSDCVWGLTTVERRAENSGGLRPWRWLLHLRGSRGLDVAPSANRKPWHLPEPWSQGVRAGLALSSCREL

SEQ ID NO: 893498 - protein, 594 aa, Homo sapiens; identical to SEQ ID NO: 893485

SEQ ID NO: 893499 - protein, 594 aa, Homo sapiens; identical to SEQ ID NO: 893485

SEQ ID NO: 893500 - protein, 623 aa, Homo sapiens
GGGEERAAAQSKLSRAEPSWGRRAREAAAARSPGGSAAGWECPSVLDEAGACTMSSCVSSQPSSNRAAPQDELGGRGSSSSESQKPCEALRGLSSLSIHLGMESFIVVTECEPGCAVDLGLARDRPLEADGQEVPLDSSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKTSAAITTINFTTFSSAQEDTLHSLAVPIQLPHPSNHSE

SEQ ID NO: 893501 - protein, 710 aa, Homo sapiens [sequence omitted]

SEQ ID NO: 893502 - protein, 731 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFQERGAPGQQEEEEVTAPALIQDCTPPPPSSHPTSLRLTGLHFVVKKGFRPGAVAHACNPTL

SEQ ID NO: 893503 - protein, 483 aa, Homo sapiens
CPHPAYSALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 893504 - protein, 497 aa, Homo sapiens
FLSPICATSDQAILATQGRLTVPTHIASHPPGPPGVSLKAEDSLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 893505 - protein, 598 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 893506 - protein, 124 aa, Homo sapiens
MHPFRVCQSPPKRLTCIFSANSYHRSMQHNIPDPTSQEETEITYTCPGVRVVVQLGFQIPQAACLPVPDFLAPGSALTGLCCGSVEDLERNNGSLDRPYYMSKSLLKILGKKNEAPPDNKKRKK

SEQ ID NO: 893507 - protein, 136 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKLSTKARRGVQERGEVGWAGDTPPTQAPDLSVLFHSLSLLSPPHLSLPESDNSRPR

SEQ ID NO: 893508 - protein, 573 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAGHEGTRARS

SEQ ID NO: 893509 - protein, 269 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVALGVALVLSLLFISLEPLPPSTGPSTSPRTSLPSP

SEQ ID NO: 893510 - protein, 43 aa, Homo sapiens
DYRREPPRPAGVSPLRRWTAGAVPVNSFVSLQGCGTDDVYHVL

SEQ ID NO: 893511 - protein, 837 aa, Homo sapiens
GPVARHVAAGAGHENKHGGSRRFPAGVAPRRAMANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAMLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 893512 - protein, 405 aa, Homo sapiens
MLARNCPLWDSAHRAHWALHNPGACRRSGRSCCCQSDCARALPDPRPDRALQAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLYTACEDGCGPSGNQYMTWKDLTMLTMNHPRINLASKDYEPFTTRNIVGTWFKTQATSIQLSEQVRPREKNGLTRRLQEEQPGEQTDKWKSDNERGNTERDGYTRAMSNEQATSTRIEARKNTRDTNEQSIVRTTESDVRRHKTEHHDRQHTTEEKRNEERQ

SEQ ID NO: 893513 - protein, 837 aa, Homo sapiens; identical to SEQ ID NO: 893511

SEQ ID NO: 893514 - protein, 837 aa, Homo sapiens; identical to SEQ ID NO: 893511

SEQ ID NO: 893515 - protein, 837 aa, Homo sapiens; identical to SEQ ID NO: 893511

SEQ ID NO: 893516 - protein, 837 aa, Homo sapiens; identical to SEQ ID NO: 893511

SEQ ID NO: 893517 - protein, 309 aa, Homo sapiens
VRGHEVCSWLWGCWAWAGPPPSVYLGGFGPATTLTPPPCHLPQIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 893518 - protein, 271 aa, Homo sapiens
TLEKPGERQDGPMPLMELLPRLSGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 893519 - protein, 649 aa, Homo sapiens
GPVARHVAAGAGHENKHGGSRRFPAGVAPRRAMANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAMLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIELPAAPARRAAPARRHLRL

SEQ ID NO: 893520 - protein, 285 aa, Homo sapiens
GPVARHVAAGAGHENKHGGSRRFPAGVAPRRAMANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGSILPSAAAAAWEGVVAWAESRAEVLSPACSSAGGGGPARLAVSLSWLGRETSLGCPVNIMAPPSRVASARLVCGAGLRSGLGGPDGEAASPP

SEQ ID NO: 893521 - protein, 130 aa, Homo sapiens
LAFLLPREAENREPSGDRWARELRLLGSWKVTVRPETGSGAGQSCGGGSRGGPVSPSSLLGSYNPLTLGLFTLVYFFLACWTYGLTVSAGVFIPSLLIGAAWGRLFGISLSYLTGAAVSGAGGEAVGPCS

SEQ ID NO: 893522 - protein, 933 aa, Homo sapiens
GPVARHVAAGAGHENKHGGSRRFPAGVAPRRAMANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGSILPSAAAAAWEGVVAWAESRAEVLSPACSSAGGGGPARLAVSLSWLGRETSLGCPVNIMAPPSRVASARLVCGAGLRSGLGGLTGKQPALLDEPPDIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAMLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 893523 - protein, 740 aa, Homo sapiens
MLARNCPLWDSAHRAHWALHNPGACRRSGRSCCCQSDCARALPDPRPDRALQAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAMLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 893524 - protein, 470 aa, Homo sapiens
VPSGLSQKGTQIPDHFRPPLRKPGKWCAMHVKMAYTIHEIPVFIAMGVVGGVLGAVFNALNYWLTMFRIRYIHRPCLQVIEAMLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 893525 - protein, 837 aa, Homo sapiens; identical to SEQ ID NO: 893511

SEQ ID NO: 893526 - protein, 837 aa, Homo sapiens; identical to SEQ ID NO: 893511

SEQ ID NO: 893527 - protein, 115 aa, Homo sapiens
RRIALSFTNLKFSLSVGSSQAPGANSTQADEGKTKKGVLEAPDTQVNPVGSVSVDCGPSRADRCSPKEDQAWDGASQDCPPLPAGVSFHIVQRLTSDAELCASNLQKAEHITSAP

SEQ ID NO: 893528 - protein, 768 aa, Homo sapiens
WVSGRALGAAAPRWVLGPTQRWGVSQASRHRCCRHHCVGLVQPRARPRPGQERRGFVMHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVPPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 893529 - protein, 515 aa, Homo sapiens
MESMLGGLCQLYRWLAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVPPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 893530 - protein, 577 aa, Homo sapiens
WVSGRALGAAAPRWVLGPTQRWGVSQASRHRCCRHHCVGLVQPRARPRPGQERRGFVMHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDVLFQVYH

SEQ ID NO: 893531 - protein, 768 aa, Homo sapiens; identical to SEQ ID NO: 893528

SEQ ID NO: 893532 - protein, 227 aa, Homo sapiens
WVSGRALGAAAPRWVLGPTQRWGVSQASRHRCCRHHCVGLVQPRARPRPGQERRGFVMHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVDKDEGG

SEQ ID NO: 893533 - protein, 425 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 893534 - protein, 299 aa, Homo sapiens [sequence omitted]

SEQ ID NO: 893535 - protein, 250 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKVSDYVNLLHY

SEQ ID NO: 893536 - protein, 220 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYEVL

SEQ ID NO: 893537 - protein, 427 aa, Homo sapiens
RKALPGKLRRGMHSVQMGVQWRGPADILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 893538 - protein, 422 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVVLAGRNEHWY

SEQ ID NO: 893539 - protein, 103 aa, Homo sapiens [sequence omitted]

SEQ ID NO: 893540 - protein, 362 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 893541 - protein, 362 aa, Homo sapiens; identical to SEQ ID NO: 893540

SEQ ID NO: 893542 - protein, 362 aa, Homo sapiens; identical to SEQ ID NO: 893540

SEQ ID NO: 893543 - protein, 362 aa, Homo sapiens; identical to SEQ ID NO: 893540

SEQ ID NO: 893544 - protein, 362 aa, Homo sapiens; identical to SEQ ID NO: 893540

SEQ ID NO: 893545 - protein, 116 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGLRKVWMMMKMDKIQSAY

SEQ ID NO: 893546 - protein, 194 aa, Homo sapiens
MAQQQMTSSQKALMLELKSLQEEPVEGFRITLVDESDLYNWEVAIFGPPNTLYEGGYFKAHIKFPIDYPYSPPTFRFLTKMWHPNIYENGDVCISILHPPVDDPQSGELPSERWNPTQNVRTILLSVISLLNEPNTFSPANVDASVMFRKWRDSKGKDKEYAEIIRKQVSATKAEAEKDGVKVPTTLGGILHQN

SEQ ID NO: 893547 - protein, 194 aa, Homo sapiens; identical to SEQ ID NO: 893546

SEQ ID NO: 893548 - protein, 194 aa, Homo sapiens; identical to SEQ ID NO: 893546

SEQ ID NO: 893549 - protein, 194 aa, Homo sapiens; identical to SEQ ID NO: 893546

SEQ ID NO: 893550 - protein, 194 aa, Homo sapiens; identical to SEQ ID NO: 893546

SEQ ID NO: 893551 - protein, 165 aa, Homo sapiens
MAQQQMTSSQKALMLELKSLQEEPVEGFRITLVDESDLYNWEVAIFGPPNTLYEGGYFKNGDVCISILHPPVDDPQSGELPSERWNPTQNVRTILLSVISLLNEPNTFSPANVDASVMFRKWRDSKGKDKEYAEIIRKQVSATKAEAEKDGVKVPTTLGGILHQN

SEQ ID NO: 893552 - protein, 194 aa, Homo sapiens; identical to SEQ ID NO: 893546

SEQ ID NO: 893553 - protein, 149 aa, Homo sapiens
MAQQQMTSSQKALMLELKSLQEEPVEGFRITLVDESDLYNWEVAIFGPPNTLYEGGYFKAHIKFPIDYPYSPPTFRFLTKMWHPNIYENGDVCISILHPPVDDPQSGELPSERWNPTQNVRKQVSATKAEAEKDGVKVPTTLGGILHQN

SEQ ID NO: 893554 - protein, 69 aa, Homo sapiens
SSFKIKQNKKVLRRRLKKFALHNLHESNAITSQHAFRVACGGGNTHSMREDARLFMDGWMDFWGIEGVR

SEQ ID NO: 893555 - protein, 109 aa, Homo sapiens
MDGWISGELREFVDVAPFSGPLLAPVLPCHAQAKGRGAKWGDPWPWPPQAKTLFPPAGWGKHTHSSLLTPPLWDPQFGSLFMGPFNGRESNPSHRMSEFLHSLPFPSLY

SEQ ID NO: 893556 - protein, 194 aa, Homo sapiens; identical to SEQ ID NO: 893546

SEQ ID NO: 893557 - protein, 169 aa, Homo sapiens
MAQQQMTSSQKALMLELKSLQEEPVEGFRITLVDESDLYNWEVAIFGPPNTLYEGGYFKAHIKFPIDYPYSPPTFRFLTKMWHPNIYENGDVCISILHPPVDDPQSGELPSERWNPTQNVRTILLSVISLLNEPNTFSPANVDASVMFRKWRDSKKKKQICQGLAAHLH

SEQ ID NO: 893558 - protein, 169 aa, Homo sapiens; identical to SEQ ID NO: 893557

SEQ ID NO: 893559 - protein, 317 aa, Homo sapiens
MPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 893560 - protein, 466 aa, Homo sapiens
MYIAFVLNVECTLDIWYECVLYIHGCCLHATRMHLPSVFHLCCMCPACGLLYMCIMGAAFLLNVYCVSHISWVLHEYCMHLVLFHSFCNIVFYLYITCIFHVFLCMLYASCGIHAHAPHMLRVNCVVCVWRVCFGVLPSDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 893561 - protein, 737 aa, Homo sapiens
SWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 893562 - protein, 83 aa, Homo sapiens [sequence omitted]

SEQ ID NO: 893563 - protein, 105 aa, Homo sapiens
CPYTCSVSVSCPHLPSFSLGPCDWLFVFFCCPSQNQEKLPATAAHPPAGDVVPQVSAPRLWGRAVDEGSHSPLPLTWLPCPYRPACMVPSITHGLSLILAPLASS

SEQ ID NO: 893564 - protein, 315 aa, Homo sapiens
MPRVYIGRLSYNVREKDIQRFFSGYGRLLEVDLKNGYGFVEFEDSRDADDAVYELNGKELCGERVIVEHARGPRRDRDGYSYGSRSGGGGYSSRRTSGRDKYGPPVRTEYRLIVENLSSRCSWQDLKDFMRQAGEVTYADAHKERTNEGVIEFRSYSDMKRALDKLDGTEINGRNIRLIEDKPRTSHRRSYSGSRSRSRSRRRSRSRSRRSSRSRSRSISKSRSRSRSRSKGRSRSRSKGRKSRSKSKSKPKSDRGSHSHSRSRSKDEYEKSRSRSRSRSPKENGKGDIKSKSRSRSQSRSNSPLPVPPSKARSV

SEQ ID NO: 893565 - protein, 225 aa, Homo sapiens
MPRVYIGRLSYNVREKDIQRFFSGYGRLLEVDLKNGYGFVEFEDSRDADDAVYELNGKELCGERVIVEHARGPRRDRDGYSYGSRSGGGGYSSRRTSGRDKYGPPVRTEYRLIVENLSSRCSWQDLKDFMRQAGEVTYADAHKERTNEGVIEFRSYSDMKRALDKLDGTEINGRNIRLIEDKPRTSHRRSYSGSRSRSRSRRRSRSRSRRSSRSRSRSISKSRSR

SEQ ID NO: 893566 - protein, 344 aa, Homo sapiens
MPRVYIGRLSYNVREKDIQRFFSGYGRLLEVDLKNGYGFVEFEDSRDADDAVYELNGKELCGERVIVEHARGPRRDRDGYSYGSRSGGGGYSSRRTSGRDKYGPPVRTEYRLIVENLSSRCSWQDLKDFMRQAGEVTYADAHKERTNEGVIEFRSYSDMKRALDKLDGTEINGRNIRLIEDKPRTSHRRSYSGSRSRSRSRRRSRSRSRRSSRSRSRSISKSRSRSRSRSKGRSRSRSKGRKSRSKSKSKPKSDRGSHSHSRSRSKDEYEKSRSRSRSRSPKENGKGDIKSKSRSRSQSRSNSPLPVPPSKARSVSPPPKRATSRSRSRSRSKSRSRSRSSSRD

SEQ ID NO: 893567 - protein, 215 aa, Homo sapiens [sequence omitted]

SEQ ID NO: 893568 - protein, 344 aa, Homo sapiens; identical to SEQ ID NO: 893566

SEQ ID NO: 893569 - protein, 344 aa, Homo sapiens; identical to SEQ ID NO: 893566

SEQ ID NO: 893570 - protein, 117 aa, Homo sapiens [sequence omitted]

SEQ ID NO: 893571 - protein, 203 aa, Homo sapiens
VVFDVSDYLIYCIVNECYSDKYWNSTEISGINIKLIDHKAITIPRPAYSVQQLRCFRILHELTRSRSRRSSRSRSRSISKSRSRSRSRSKGRSRSRSKGRKSRSKSKSKPKSDRGSHSHSRSRSKDEYEKSRSRSRSRSPKENGKGDIKSKSRSRSQSRSNSPLPVPPSKARSVSPPPKRATSRSRSRSRSKSRSRSRSSSRD

SEQ ID NO: 893572 - protein, 105 aa, Homo sapiens
LPSFRADFKESLTLTHTSHSHSRSRSKDEYEKSRSRSRSRSPKENGKGDIKSKSRSRSQSRSNSPLPVPPSKARSVSPPPKRATSRSRSRSRSKSRSRSRSSSRD

SEQ ID NO: 893573 - protein, 344 aa, Homo sapiens; identical to SEQ ID NO: 893566

SEQ ID NO: 893574 - protein, 344 aa, Homo sapiens; identical to SEQ ID NO: 893566

SEQ ID NO: 893575 - protein, 344 aa, Homo sapiens; identical to SEQ ID NO: 893566

SEQ ID NO: 893576 - protein, 344 aa, Homo sapiens; identical to SEQ ID NO: 893566

SEQ ID NO: 893577 - protein, 80 aa, Homo sapiens
YEESKEQGTSKHLFKENYEPLLKEIKEDTNKWKNIPCSWVGRINIVKMAILPNLRNIVPQKADASSIILFSLILYLIRCL

SEQ ID NO: 893578 - protein, 344 aa, Homo sapiens; identical to SEQ ID NO: 893566

SEQ ID NO: 893579 - protein, 109 aa, Homo sapiens
MGESGLGARAQRPRPGGGGNSPRKEAAKAAAPRGRASKMATARRRGGARWGTGARTCASWLTTPPRLSGPRTAPRYGFVEFEDSRDADDAVYELNGKELCGERVIVEHA

SEQ ID NO: 893580 - protein, 120 aa, Homo sapiens [sequence omitted]

SEQ ID NO: 893581 - protein, 344 aa, Homo sapiens; identical to SEQ ID NO: 893566

SEQ ID NO: 893582 - protein, 215 aa, Homo sapiens [sequence omitted]

SEQ ID NO: 893583 - protein, 215 aa, Homo sapiens [sequence omitted]

SEQ ID NO: 893584 - protein, 344 aa, Homo sapiens; identical to SEQ ID NO: 893566

SEQ ID NO: 893585 - protein, 344 aa, Homo sapiens; identical to SEQ ID NO: 893566

SEQ ID NO: 893586 - protein, 344 aa, Homo sapiens; identical to SEQ ID NO: 893566

SEQ ID NO: 893587 - protein, 344 aa, Homo sapiens; identical to SEQ ID NO: 893566

SEQ ID NO: 893588 - protein, 344 aa, Homo sapiens; identical to SEQ ID NO: 893566

SEQ ID NO: 893589 - protein, 344 aa, Homo sapiens; identical to SEQ ID NO: 893566

SEQ ID NO: 893590 - protein, 107 aa, Homo sapiens
MCTFSLSIEKIGLSLSSSRSRSKGRSRSRSKGRKSRSKSKSKPKSDRGSHSHSRSRSKDEYEKSRSRSRSRSPKENGKGDIKSKSRSRSQSRSNSPLPVPPSKARSV

SEQ ID NO: 893591 - protein, 228 aa, Homo sapiens
GRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVKGKFNFSGMH

SEQ ID NO: 893592 - protein, 1597 aa, Homo sapiens
GRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893593 - protein, 1608 aa, Homo sapiens
GRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKSPSKWYWKLVPVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893594 - protein, 1403 aa, Homo sapiens
MREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893595 - protein, 1283 aa, Homo sapiens
MVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893596 - protein, 1597 aa, Homo sapiens; identical to SEQ ID NO: 893592

SEQ ID NO: 893597 - protein, 657 aa, Homo sapiens
KEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVLQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893598 - protein, 292 aa, Homo sapiens
SSVWACVSLRRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893599 - protein, 256 aa, Homo sapiens
SRYPYQALEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 893600 - protein, 69 aa, Homo sapiens
AGRGEGNRYRGQVLVCRNPFMNRRLFLSLAADNLSRTQSGSSLSLASAATTEPESVHSGGTPSQRSQAL

SEQ ID NO: 893601 - protein, 1441 aa, Homo sapiens
GRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRIVAIMSSGIPVPFTRAPQLVKR

SEQ ID NO: 893602 - protein, 326 aa, Homo sapiens
GRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKVITNYLACSFKTMCE

SEQ ID NO: 893603 - protein, 160 aa, Homo sapiens
GWRKMEAPPDGAADLVPLDRYDAARAKIAANLQWICAKAYGRGGPGEGRGAGARGAGRGRGTRPGSGRVGVRAPRLCAASAQGRGWAGRLRGPGGARATRSVGTRSPGEWASLRRRAAWVGASAPISGVPPASRWRRRRREGAARFWAQGGTMGTRGRRL

SEQ ID NO: 893604 - protein, 498 aa, Homo sapiens
AARGQLEFGYWTQEGREREELVAVGSGSGRHRAPAPPLECAEGGASRAPAAQPRRSGQVCARSPLTLGLPEPATTSAPHHLGFLYCKETGKEGRKTSPERANRRKTALPGGAGRAGARGSGRRAGARPGRGRGRRGQKRRRAALRPVCGVGLGFGLAAAVEKMLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 893605 - protein, 498 aa, Homo sapiens; identical to SEQ ID NO: 893604

SEQ ID NO: 893606 - protein, 259 aa, Homo sapiens
MDSSKVDINGNSLVLGHGGKRETALDGRTKNFTTQTRLESLGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 893607 - protein, 245 aa, Homo sapiens
MIGIYCLKTCLPLCLFLFASVTLFSLQGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 893608 - protein, 243 aa, Homo sapiens
MDGRCAGGFLEELMSVGIHFFSKVKGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 893609 - protein, 203 aa, Homo sapiens
GQRIDQKRPTLHAREHTHTRYGHTVPLSDGGKAFCIIYSVIGIPFTLLFLTAVVQRITVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 893610 - protein, 498 aa, Homo sapiens; identical to SEQ ID NO: 893604

SEQ ID NO: 893611 - protein, 498 aa, Homo sapiens; identical to SEQ ID NO: 893604

SEQ ID NO: 893612 - protein, 284 aa, Homo sapiens
AARGQLEFGYWTQEGREREELVAVGSGSGRHRAPAPPLECAEGGASRAPAAQPRRSGQVCARSPLTLGLPEPATTSAPHHLGFLYCKETGKEGRKTSPERANRRKTALPGGAGRAGARGSGRRAGARPGRGRGRRGQKRRRAALRPVCGVGLGFGLAAAVEKMLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGEWG

SEQ ID NO: 893613 - protein, 254 aa, Homo sapiens
VLRVLSPDLVRRLLNLAVRAFQVPKGESLNFPESTPGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 893614 - protein, 698 aa, Homo sapiens
MEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 893615 - protein, 682 aa, Homo sapiens
SSDIELWALSRTVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 893616 - protein, 831 aa, Homo sapiens [sequence omitted]

SEQ ID NO: 893617 - protein, 689 aa, Homo sapiens
MEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANCLALPNPSPVRDPQSDRS

SEQ ID NO: 893618 - protein, 270 aa, Homo sapiens
ALWEAELEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQLLLDTHSLKMVLLDLPSISSQVVRKAPASYTKIVVKGMTRAEMILKVVMAPHEPLVVFVDNYIKLLTDCNTETFQKILDMKGLKRSEQSSMLELLRQRLPAPPSGAESSGSLSLTAPTPEQESSRIRKLEKLIKKRL

SEQ ID NO: 893619 - protein, 120 aa, Homo sapiens
RTGQWNPWIILITWSVDSTRREPMELLWLSSLSRTVEKGRWGPSPNSTASSAVCPQPRRAGKASGLLHLVLVTPGVCVQITTSLFGSLLRSRFPDGSITALSYQAAVFHSWWSQPGKLLS

SEQ ID NO: 893620 - protein, 669 aa, Homo sapiens
MEEEELEFVEELEAVLQLTPEVQLAIEQVFPSQDPLDRADFNAVEYINTLFPTEQSLANIDEVVNKIRLKIRRLDDNIRTVVRGQTNVGQDGRQVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 893621 - protein, 831 aa, Homo sapiens [sequence omitted]

SEQ ID NO: 893622 - protein, 785 aa, Homo sapiens
MEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQLLLDTHSLKMVLLDLPSISSQVVRKAPASYTKIVVKGMTRAEMILKVVMAPHEPLVVFVDNYIKLLTDALQPGDRVRLYLKTNKKTDARRF

SEQ ID NO: 893623 - protein, 688 aa, Homo sapiens
MEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHPHPLLEFL

SEQ ID NO: 893624 - protein, 140 aa, Homo sapiens
MSLLLLDTHSLKMVLLDLPSISSQVVRKAPASYTKIVVKGMTRAEMILKVVMAPHEPLVVFVDNYIKLLTDCNTETFQKILDMKGLKRSEQSSMLELLRQRLPAPPSGAESSGSLSLTAPTPEQESSRIRKLEKLIKKRL

SEQ ID NO: 893625 - protein, 396 aa, Homo sapiens
MEEEELEFVEELEAVLQLTPEVQLAIEQVFPSQDPLDRADFNAVEYINTLFPTEQSLANIDEVVNKIRLKIRRLDDNIRTVVRGQTNVGQDGRQALEEAQKAIQQLFGKIKDIKDKAEKSEQMVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLVRPSLGSCHVKSVGWVVGIQGFTVW

SEQ ID NO: 893626 - protein, 540 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 893627 - protein, 467 aa, Homo sapiens
MKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 893628 - protein, 136 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYSKYLSVSFPIWTANQNTDTTPMSGEPQVLPLGSN

SEQ ID NO: 893629 - protein, 102 aa, Homo sapiens
AVISPMTSRVAGSFLEALAVIADLGNGAGGVWGRKRPSGLRSMWWPFVPCKTLSHGVGRQRWIFASIPVEGGAVALFITSIGVYTTTCLTSGYFGILLDICS

SEQ ID NO: 893630 - protein, 540 aa, Homo sapiens; identical to SEQ ID NO: 893626

SEQ ID NO: 893631 - protein, 540 aa, Homo sapiens; identical to SEQ ID NO: 893626

SEQ ID NO: 893632 - protein, 583 aa, Homo sapiens
AVISPMTSRVAGSFLEALAVIADLGNGAGGVWGRKRPSGLRSMWWPFVPCKTLSHGVGRQRWIFASAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 893633 - protein, 467 aa, Homo sapiens; identical to SEQ ID NO: 893627

SEQ ID NO: 893634 - protein, 467 aa, Homo sapiens; identical to SEQ ID NO: 893627

SEQ ID NO: 893635 - protein, 471 aa, Homo sapiens
FIFFIIKVSFLLCQSLVFIQSTKLWSEYRLLSISICCSRDKGKHRCFPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 893636 - protein, 396 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIR

SEQ ID NO: 893637 - protein, 107 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYMPLFH

SEQ ID NO: 893638 - protein, 166 aa, Homo sapiens [sequence omitted]

SEQ ID NO: 893639 - protein, 540 aa, Homo sapiens; identical to SEQ ID NO: 893626

SEQ ID NO: 893640 - protein, 540 aa, Homo sapiens; identical to SEQ ID NO: 893626

SEQ ID NO: 893641 - protein, 500 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNILLVIIKGFNLLGKRGCEAENGMVRILSQVRFSGDKGGLGEGGSPEGPWGNK

SEQ ID NO: 893642 - protein, 338 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGKT

SEQ ID NO: 893643 - protein, 66 aa, Homo sapiens
AVISPMTSRVAGSFLEALAVIADLGNGAGGVWGRKRPSGLRSMWWPFVPCKTLSHGVGRQRWIFAS

SEQ ID NO: 893644 - protein, 1129 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 893645 - protein, 84 aa, Homo sapiens
KKGKDLRLRVLSTKKKEKVWANKAKGETASEGTEAKKRKRVVDESDETENQEEKAKENLNLSKKQKPLDFSTNQKLSAFAFKQE

SEQ ID NO: 893646 - protein, 1129 aa, Homo sapiens; identical to SEQ ID NO: 893644

SEQ ID NO: 893647 - protein, 1129 aa, Homo sapiens; identical to SEQ ID NO: 893644

SEQ ID NO: 893648 - protein, 1067 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPCISLTDSCKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 893649 - protein, 990 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQHLQLLFRKNLTITSEEEI

SEQ ID NO: 893650 - protein, 481 aa, Homo sapiens [sequence omitted]

SEQ ID NO: 893651 - protein, 1067 aa, Homo sapiens; identical to SEQ ID NO: 893648

SEQ ID NO: 893652 - protein, 277 aa, Homo sapiens
SLRLPVPNHVDASGLLEAARAAAVGVAATTTIGVTSPASVRSRRSRAAHVSSESAHMATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSVDVLKATALPLLKQFGIDGESFELKIVRRGMPPGGGGEVVFSCPVRKVLKPIQLTDPGKIKRIRGMAVLCTCVTSDGEPDCGFCKEHPQQVHT

SEQ ID NO: 893653 - protein, 277 aa, Homo sapiens; identical to SEQ ID NO: 893652

SEQ ID NO: 893654 - protein, 277 aa, Homo sapiens; identical to SEQ ID NO: 893652

SEQ ID NO: 893655 - protein, 170 aa, Homo sapiens
MANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 893656 - protein, 187 aa, Homo sapiens
MTSLTPGCRYSVRVSPQMANRIVDSARSILNKFIPDIYIYTDHMKGVNSGKSPGFGLSLVAETTSGTFLSAELASNPQGQGAAVLPEDLGRNCARLLLEEIYRGGCVDSTNQSLALLLMTLGQQDVSKVLLGPLSPYTIEFLRHLKSFFQIMFKIETKPCGEELKGGDKVLMTCVGIGFSNLSKTLK

SEQ ID NO: 893657 - protein, 187 aa, Homo sapiens; identical to SEQ ID NO: 893656

SEQ ID NO: 893658 - protein, 187 aa, Homo sapiens; identical to SEQ ID NO: 893656

SEQ ID NO: 893659 - protein, 277 aa, Homo sapiens; identical to SEQ ID NO: 893652

SEQ ID NO: 893660 - protein, 170 aa, Homo sapiens; identical to SEQ ID NO: 893655

SEQ ID NO: 893661 - protein, 170 aa, Homo sapiens; identical to SEQ ID NO: 893655

SEQ ID NO: 893662 - protein, 187 aa, Homo sapiens; identical to SEQ ID NO: 893656

SEQ ID NO: 893663 - protein, 199 aa, Homo sapiens
SLRLPVPNHVDASGLLEAARAAAVGVAATTTIGVTSPASVRSRRSRAAHVSSESAHMATQAHSLSYAGCNFLRQRLVLSTLSGRPVKIRKIRARDDNPGLRDFEASFIRLLDKITNGSRIEINQTGTTLYYQPGLLYGGSVEHDCSVLRGIGYYLESLLCLAPFMKHPLKIVLRGVTNDQVDPSDRIFAAFEELFPDYV

SEQ ID NO: 893664 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 893665 - protein, 651 aa, Homo sapiens; identical to SEQ ID NO: 893664

SEQ ID NO: 893666 - protein, 603 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 893667 - protein, 651 aa, Homo sapiens; identical to SEQ ID NO: 893664

SEQ ID NO: 893668 - protein, 603 aa, Homo sapiens; identical to SEQ ID NO: 893666

SEQ ID NO: 893669 - protein, 457 aa, Homo sapiens
MGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 893670 - protein, 61 aa, Homo sapiens
MWEVRGPLPHPPPPPVESLTFILHPGPPWCSSISWALWLSEPVVGTPSTGPKPGGAAADEV

SEQ ID NO: 893671 - protein, 635 aa, Homo sapiens
ARQRAEPAGSGARVPRRGWRQRAPSSARARPSGSPTPSGPRRPSARPRKHPPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 893672 - protein, 504 aa, Homo sapiens
ARQRAEPAGSGARVPRRGWRQRAPSSARARPSGSPTPSGPRRPSARPRKHPPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRCGPALVSAGLGACPLAPSPSPSAPPDPSGQAGLLLRPQAVLATLMPAGPDLPSRKANTVASVLLDVALGLMLLSWLHGRSRIGHLADALVPVADVSGLGWSPVSRVGVGTPPGQQSLPGPEPPPHKASSTFSMLWRHGPPLNQKQELQGRWGLGRAGLAGTPPFPSEGAVCRSQPG

SEQ ID NO: 893673 - protein, 598 aa, Homo sapiens
GSGFHEGQVQSVSQPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 893674 - protein, 635 aa, Homo sapiens; identical to SEQ ID NO: 893671

SEQ ID NO: 893675 - protein, 635 aa, Homo sapiens; identical to SEQ ID NO: 893671

SEQ ID NO: 893676 - protein, 614 aa, Homo sapiens
ARQRAEPAGSGARVPRRGWRQRAPSSARARPSGSPTPSGPRRPSARPRKHPPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAGSEPWRPEATGLCSSALGFSGLGSLNCRPGAKRGKVRGTRSQQGGHHPLA

SEQ ID NO: 893677 - protein, 651 aa, Homo sapiens
ARQRAEPAGSGARVPRRGWRQRAPSSARARPSGSPTPSGPRRPSARPRKHPPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAGSEPWRPEATGLCSSALGFSGLGSLNCRPGAKRGKVRGTRSQQGGHHPVSAPSGCAGKPRPLNSTACARPSLGLFPACRTPGFFQWS

SEQ ID NO: 893678 - protein, 450 aa, Homo sapiens
ARQRAEPAGSGARVPRRGWRQRAPSSARARPSGSPTPSGPRRPSARPRKHPPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADVSGLGWSPVSRVGVGTPPGQQSLPGPEPPPHKASSTFSMLWRHGPPLNQKQELQGRWGLGRAGLAGTPPFPSEGAVCRSQPG

SEQ ID NO: 893679 - protein, 814 aa, Homo sapiens
ARQRAEPAGSGARVPRRGWRQRAPSSARARPSGSPTPSGPRRPSARPRKHPPPGMVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLADKPTALQPRGAHLPPPQLWLPPQALLGRPVPQAVPWGAHLPLEAERGQAGLRELLARLAPPHGHSQPSALPGWHQLSWRMSCALWTLLCAPEHGRPCYHTLGLEVIGSEQMWGWPARLAALHHWHCLPWDPLPTCCGHHGGEHSNPRCPEHCPMPTLCTQVQRVRPPQQPQVEGWSPWGLPSGSALAVGVEGPCQDEPPSPRHPLAPSAEQHPASGGLKQSLTPVPSGPGPSLPEPHGVYLRMFPGEVAL

SEQ ID NO: 893680 - protein, 515 aa, Homo sapiens
RVFYAILSAPYGSYKNRTRAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLAAGVKFRVLRHEAGRPLRLLMQINPLPYSRVVHTYRLPSCGCHPKHSWGALCRKLFLGELIYPWRQRGDKQD

SEQ ID NO: 893681 - protein, 635 aa, Homo sapiens; identical to SEQ ID NO: 893671

SEQ ID NO: 893682 - protein, 306 aa, Homo sapiens
GCRLTCLLGNWDWLLPQARECLRQHWPCLTTARPHPLSADGVGAQTTPLTAALVLPDKPTALQPRGAHLPPPQLWLPPQALLGRPVPQAVPWGAHLPLEAERGQAGLRELLARLAPPHGHSQPSALPGWHQLSWRMSCALWTLLCAPEHGRPCYHTLGLEVIGSEQMWGWPARLAALHHWHCLPWDPLPTCCGHHGGEHSNPRCPEHCPMPTLCTQVQRVRPPQQPQVEGWSPWGLPSGSALAVGVEGPCQDEPPSPRHPLAPSAEQHPASGGLKQSLTPVPSGPGPSLPEPHGVYLRMFPGEVAL

SEQ ID NO: 893683 - protein, 450 aa, Homo sapiens; identical to SEQ ID NO: 893678

SEQ ID NO: 893684 - protein, 285 aa, Homo sapiens
SRTTSSTCLIPRPRSPLHVRLWGGTSDLVRGPGAPPPALLQSKAQWQTPCPAQGGVPALPRTLQPLGPLHRGPGWGRTALPPGASGRAGPKCSSATAPAPGGRRAGPDPSARGPHQLPAAVLTGSSALPALQAGGEVLRIGQLALGMVEGNHTCGPCRSKDSMGHCASSLEAVVCMRKRAGRTGPPSPRGLQDQLPPGRWRETQRLTCRAGSEPWRPEATGLCSSALGFSGLGSLNCRPGAKRGKVRGTRSQQGGHHPVSAPSGCAGKPRPLNSTACARPSLGLF

SEQ ID NO: 893685 - protein, 249 aa, Homo sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPGLHLLRRE

SEQ ID NO: 893686 - protein, 249 aa, Homo sapiens; identical to SEQ ID NO: 893685

SEQ ID NO: 893687 - protein, 159 aa, Homo sapiens
MILYLVRSLVISVTRAPFIPLYVYPCCRHARCRRTGTLQSNFCASSLVVTATVKSMVREPGEGLAVTVSLIGAYKTGGLDLPSPPTGASLKFYVPCKQCPPMKKGVSYLLMGQVEENRGPVLPPESFVVLHRPNQDQILTNLSKRKCPSQPVRAAASQD

SEQ ID NO: 893688 - protein, 249 aa, Homo sapiens; identical to SEQ ID NO: 893685

SEQ ID NO: 893689 - protein, 249 aa, Homo sapiens; identical to SEQ ID NO: 893685

SEQ ID NO: 893690 - protein, 298 aa, Homo sapiens
LLGLEGWSSCQAHFSLIFVGVWDTPALSWLVEAAPGLSRPFHFIPQLPSLEFHPHHLIPILPVLPRPTRPCSFLTPFLFSRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPGLHLLRRE

SEQ ID NO: 893691 - protein, 242 aa, Homo sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPG

SEQ ID NO: 893692 - protein, 104 aa, Homo sapiens [sequence omitted]

SEQ ID NO: 893693 - protein, 205 aa, Homo sapiens [sequence omitted]

SEQ ID NO: 893694 - protein, 249 aa, Homo sapiens; identical to SEQ ID NO: 893685

SEQ ID NO: 893695 - protein, 82 aa, Homo sapiens
HEVKLQGGTSGWRRQVQSSSFISTNKTGVSYLLMGQVEENRGPVLPPESFVVLHRPNQDQILTNLSKRKCPSQPVRAAASQD

SEQ ID NO: 893696 - protein, 249 aa, Homo sapiens; identical to SEQ ID NO: 893685

SEQ ID NO: 893697 - protein, 249 aa, Homo sapiens; identical to SEQ ID NO: 893685

SEQ ID NO: 893698 - protein, 104 aa, Homo sapiens [sequence omitted]

SEQ ID NO: 893699 - protein, 104 aa, Homo sapiens [sequence omitted]

SEQ ID NO: 893700 - protein, 279 aa, Homo sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQAPSPPKGMNSSSSSSQISVSPLMASQPPTRPCRGALPKKGKGPAPNGELSLKSSCPPSPNLRRKQRNLLQPLWTCLLHPLVPP

SEQ ID NO: 893701 - protein, 148 aa, Homo sapiens
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 893702 - protein, 148 aa, Homo sapiens; identical to SEQ ID NO: 893701

SEQ ID NO: 893703 - protein, 148 aa, Homo sapiens; identical to SEQ ID NO: 893701

SEQ ID NO: 893704 - protein, 233 aa, Homo sapiens
ESSPAFGNLQDPPQISFHSGPSVTQLRPASHGDWSAAAPATSPVAAAALRPFPGSMPTCTPESVAEPRLDMELGSAHWERRKGRWGSGTRAKWGHSSQEPSGQGGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 893705 - protein, 139 aa, Homo sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSW

SEQ ID NO: 893706 - protein, 958 aa, Homo sapiens [sequence omitted]

SEQ ID NO: 893707 - protein, 771 aa, Homo sapiens
MYETSYRRGWGFQYLHNHQPTNCMALLTGSLVLMNQGYLQEAYLWTKQVLTIMEKSLVLLREVTDGSLYEGVAYGSYTTRSLFQYMFLVQRHFNINHFGHPWLKQHFAFMYRTILPGFQRTVAIADSNYNWFYGPESQLVFLDKFVMRNGSGNWLADQIRRNRVVEGPGTPSKGQRWCTLHTEFLWYDGSLKSVPPPDFGTPTLHYFEDWGVVTYGSALPAEINRSFLSFKSGKLGGRAIYDIVHRNKYKDWIKGWRNFNAGHEHPDQNSFTFAPNGVPFITEALYGPKYTFFNNVLMFSPAVSKSCFSPWVGQVTEDCSSKWSKYKHDLAASCQGRVVAAEEKNGVVFIRGEGVGAYNPQLNLKNVQRNLILLHPQLLLLVDQIHLGEESPLETAASFFHNVDVPFEETVVDGVHGAFIRQRDGLYKMYWMDDTGYSEKATFASVTYPRGYPYNGTNYVNVTMHLRSPITRAAYLFIGPSIDVQSFTVHGDSQQLDVFIATSKHAYATYLWTGEATGQSAFAQVIADRHKILFDRNSAIKSSIVPEVKDYAAIVEQNLQHFKPVFQLLEKQILSRVRNTASFRKTAERLLRFSDKRQTEEAIDRIFAISQQQQQQSKSKKNRRAGKRYKFVDAVPDIFAQIEVNEKKIRQKAQILAQKELPIDEDEEMKDLLDFADVTYEKHKNGGLIKGRFGQARMVTTTHSRAPSLSASYTRLFLILNIAIFFVMLAMQLTYFQRAQSLHGQRCLYAVLLIDSCILLWLYSSCSQSQC

SEQ ID NO: 893708 - protein, 652 aa, Homo sapiens
MIKKYSSSSHQGFPFVHTGCPWIFLELSLIYSALPVLWVAFVCRIFHITMLCVIFTAIRKPFNFKIKYDGSLKSVPPPDFGTPTLHYFEDWGVVTYGSALPAEINRSFLSFKSGKLGGRAIYDIVHRNKYKDWIKGWRNFNAGHEHPDQNSFTFAPNGVPFITEALYGPKYTFFNNVLMFSPAVSKSCFSPWVGQVTEDCSSKWSKYKHDLAASCQGRVVAAEEKNGVVFIRGEGVGAYNPQLNLKNVQRNLILLHPQLLLLVDQIHLGEESPLETAASFFHNVDVPFEETVVDGVHGAFIRQRDGLYKMYWMDDTGYSEKATFASVTYPRGYPYNGTNYVNVTMHLRSPITRAAYLFIGPSIDVQSFTVHGDSQQLDVFIATSKHAYATYLWTGEATGQSAFAQVIADRHKILFDRNSAIKSSIVPEVKDYAAIVEQNLQHFKPVFQLLEKQILSRVRNTASFRKTAERLLRFSDKRQTEEAIDRIFAISQQQQQQSKSKKNRRAGKRYKFVDAVPDIFAQIEVNEKKIRQKAQILAQKELPIDEDEEMKDLLDFADVTYEKHKNGGLIKGRFGQARMVTTTHSRAPSLSASYTRLFLILNIAIFFVMLAMQLTYFQRAQSLHGQRCLYAVLLIDSCILLWLYSSCSQSQC

SEQ ID NO: 893709 - protein, 640 aa, Homo sapiens
MIKKYSSSSHQGFPFVHTGCPWIFLELSLIYSALPVLWVAFVCRIFHITMLCVIFTAIRKPFNFSKLFGTPTLHYFEDWGVVTYGSALPAEINRSFLSFKSGKLGGRAIYDIVHRNKYKDWIKGWRNFNAGHEHPDQNSFTFAPNGVPFITEALYGPKYTFFNNVLMFSPAVSKSCFSPWVGQVTEDCSSKWSKYKHDLAASCQGRVVAAEEKNGVVFIRGEGVGAYNPQLNLKNVQRNLILLHPQLLLLVDQIHLGEESPLETAASFFHNVDVPFEETVVDGVHGAFIRQRDGLYKMYWMDDTGYSEKATFASVTYPRGYPYNGTNYVNVTMHLRSPITRAAYLFIGPSIDVQSFTVHGDSQQLDVFIATSKHAYATYLWTGEATGQSAFAQVIADRHKILFDRNSAIKSSIVPEVKDYAAIVEQNLQHFKPVFQLLEKQILSRVRNTASFRKTAERLLRFSDKRQTEEAIDRIFAISQQQQQQSKSKKNRRAGKRYKFVDAVPDIFAQIEVNEKKIRQKAQILAQKELPIDEDEEMKDLLDFADVTYEKHKNGGLIKGRFGQARMVTTTHSRAPSLSASYTRLFLILNIAIFFVMLAMQLTYFQRAQSLHGQRCLYAVLLIDSCILLWLYSSCSQSQC

SEQ ID NO: 893710 - protein, 958 aa, Homo sapiens [sequence omitted]

SEQ ID NO: 893711 - protein, 958 aa, Homo sapiens [sequence omitted]

SEQ ID NO: 893712 - protein, 691 aa, Homo sapiens
DLEDPVSQADPLYTLLCITLEPGCGETRRYSKSNNLQSPPGHEALTFIWALVCEGCSSQPLAKNGVTFLPLLRTYVIGSQGNRVVEGPGTPSKGQRWCTLHTEFLWYDGSLKSVPPPDFGTPTLHYFEDWGVVTYGSALPAEINRSFLSFKSGKLGGRAIYDIVHRNKYKDWIKGWRNFNAGHEHPDQNSFTFAPNGVPFITEALYGPKYTFFNNVLMFSPAVSKSCFSPWVGQVTEDCSSKWSKYKHDLAASCQGRVVAAEEKNGVVFIRGEGVGAYNPQLNLKNVQRNLILLHPQLLLLVDQIHLGEESPLETAASFFHNVDVPFEETVVDGVHGAFIRQRDGLYKMYWMDDTGYSEKATFASVTYPRGYPYNGTNYVNVTMHLRSPITRAAYLFIGPSIDVQSFTVHGDSQQLDVFIATSKHAYATYLWTGEATGQSAFAQVIADRHKILFDRNSAIKSSIVPEVKDYAAIVEQNLQHFKPVFQLLEKQILSRVRNTASFRKTAERLLRFSDKRQTEEAIDRIFAISQQQQQQSKSKKNRRAGKRYKFVDAVPDIFAQIEVNEKKIRQKAQILAQKELPIDEDEEMKDLLDFADVTYEKHKNGGLIKGRFGQARMVTTTHSRAPSLSASYTRLFLILNIAIFFVMLAMQLTYFQRAQSLHGQRCLYAVLLIDSCILLWLYSSCSQSQC

SEQ ID NO: 893713 - protein, 621 aa, Homo sapiens
WVCQHDSKGNRVGVDGSMEHYYPKRHRSYTLHTAISQDYSRLKTVPHPHVGTPTSALSVDCDVCLENLATAEINRSFLSFKSGKLGGRAIYDIVHRNKYKDWIKGWRNFNAGHEHPDQNSFTFAPNGVPFITEALYGPKYTFFNNVLMFSPAVSKSCFSPWVGQVTEDCSSKWSKYKHDLAASCQGRVVAAEEKNGVVFIRGEGVGAYNPQLNLKNVQRNLILLHPQLLLLVDQIHLGEESPLETAASFFHNVDVPFEETVVDGVHGAFIRQRDGLYKMYWMDDTGYSEKATFASVTYPRGYPYNGTNYVNVTMHLRSPITRAAYLFIGPSIDVQSFTVHGDSQQLDVFIATSKHAYATYLWTGEATGQSAFAQVIADRHKILFDRNSAIKSSIVPEVKDYAAIVEQNLQHFKPVFQLLEKQILSRVRNTASFRKTAERLLRFSDKRQTEEAIDRIFAISQQQQQQSKSKKNRRAGKRYKFVDAVPDIFAQIEVNEKKIRQKAQILAQKELPIDEDEEMKDLLDFADVTYEKHKNGGLIKGRFGQARMVTTTHSRAPSLSASYTRLFLILNIAIFFVMLAMQLTYFQRAQSLHGQRCLYAVLLIDSCILLWLYSSCSQSQC

SEQ ID NO: 893714 - protein, 958 aa, Homo sapiens [sequence omitted]

SEQ ID NO: 893715 - protein, 121 aa, Homo sapiens
LLAEFPVRAVSDDLQRGRQGLSMAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 893716 - protein, 89 aa, Homo sapiens
RSHPHPPYSNDKPPTRLEAEGKKLGLVGWVQNTDRGTVQGQLQGPISKVRHMQEWLETRGSPKSHIDKANFNNEKVILKLDYSDFQIVK

SEQ ID NO: 893717 - protein, 87 aa, Homo sapiens
SGRGGLRAWVSRWRGGPGVILAAGGEDKEGLSMAEGNTLISVDYEIFGKVQGVFFRKHTQEMTVENRIAETHSKSCVPVSFATSYAG

SEQ ID NO: 893718 - protein, 69 aa, Homo sapiens
SGRGGLRAWVSRWRGGPGVILAAGGEDKEGLSMAEGNTLISVDYEIFGKVQGVFFRKHTQVCGLQALGW

SEQ ID NO: 893719 - protein, 94 aa, Homo sapiens
SGRGGLRAWVSRWRGGPGVILAAGGEDKEGLSMAEGNTLISVDYEIFGKVQGVFFRKHTQEMTVENRIAETHSKSCVPVSFATSYAGINEFKRI

SEQ ID NO: 893720 - protein, 131 aa, Homo sapiens
SGRGGLRAWVSRWRGGPGVILAAGGEDKEGLSMAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 893721 - protein, 89 aa, Homo sapiens; identical to SEQ ID NO: 893716

SEQ ID NO: 893722 - protein, 94 aa, Homo sapiens; identical to SEQ ID NO: 893719

SEQ ID NO: 893723 - protein, 233 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATRELGVKIAKAVACHNFVKAKKEVENSQAARKKKKLAWGFEAKKRWETKSNMGYM

SEQ ID NO: 893724 - protein, 233 aa, Homo sapiens; identical to SEQ ID NO: 893723

SEQ ID NO: 893725 - protein, 233 aa, Homo sapiens; identical to SEQ ID NO: 893723

SEQ ID NO: 893726 - protein, 260 aa, Homo sapiens
TQEPMRRRDVDGVLRWLLGDHFLTEEKMWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATRELGVKIAKAVACHNFVKAKKEVENSQAARKKKKLAWGFEAKKRWETKSNMGYM

SEQ ID NO: 893727 - protein, 233 aa, Homo sapiens; identical to SEQ ID NO: 893723

SEQ ID NO: 893728 - protein, 147 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKVNRPQMKPSGKSLLSILESMIDLTRLLKGKKLRSQALKRG

SEQ ID NO: 893729 - protein, 111 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKGVLF

SEQ ID NO: 893730 - protein, 147 aa, Homo sapiens; identical to SEQ ID NO: 893728

SEQ ID NO: 893731 - protein, 233 aa, Homo sapiens; identical to SEQ ID NO: 893723

SEQ ID NO: 893732 - protein, 233 aa, Homo sapiens; identical to SEQ ID NO: 893723

SEQ ID NO: 893733 - protein, 233 aa, Homo sapiens; identical to SEQ ID NO: 893723

SEQ ID NO: 893734 - protein, 233 aa, Homo sapiens; identical to SEQ ID NO: 893723

SEQ ID NO: 893735 - protein, 233 aa, Homo sapiens; identical to SEQ ID NO: 893723

SEQ ID NO: 893736 - protein, 219 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATREENHGSNVVCFSVSAIQRLVLSLCPFPDGVTSINYFSLV

SEQ ID NO: 893737 - protein, 111 aa, Homo sapiens; identical to SEQ ID NO: 893729

SEQ ID NO: 893738 - protein, 563 aa, Homo sapiens
MQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKLGVDVQRVPRSRN

SEQ ID NO: 893739 - protein, 1026 aa, Homo sapiens
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKILFIGDSTNRGIMYYLIERLNETLQEWQKVHGTKFYHNVNGGKTLISYSYYPQFWISPSLRPTFENALEHLLQRSRPLENTGQTVLVVGGVQWLNSNHLQIIHKVLKRENLLNILVIIKTLGIGFHLPVDGVHFLTQSEVQNLWKENLIILDTAKKHGYEVVDTFTITMGRYKEFLQGKCGCHFHEVVKSKLSKEYNFIKMKRSRNHIMGRYFSNQSKLQQGTVTNFRSPYHVRGPINQVCSEILLSRMCANKRTM

SEQ ID NO: 893740 - protein, 1026 aa, Homo sapiens; identical to SEQ ID NO: 893739

SEQ ID NO: 893741 - protein, 950 aa, Homo sapiens
MPRKPERSKNQWRHTLAAMAEGPYSTGLLSTAKQSFSYTSTFLTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKILFIGDSTNRGIMYYLIERLNETLQEWQKVHGTKFYHNVNGGKTLISYSYYPQFWISPSLRPTFENALEHLLQRSRPLENTGQTVLVVGGVQWLNSNHLQIIHKVLKRENLLNILVIIKTLGIGFHLPVDGVHFLTQSEVQNLWKENLIILDTAKKHGYEVVDTFTITMGRYKEFLQGKCGCHFHEVVKSKLSKEYNFIKMKRSRNHIMGRYFSNQSKLQQGTVTNFRSPYHVRGPINQVCSEILLSRMCANKRTM

SEQ ID NO: 893742 - protein, 71 aa, Homo sapiens
NETTVLAPHETIFRAEDLSVILKAYVLVTSLTPLRAFIHSTGTVWNPPKKKRFTVKVSSRLKLLFHVSTLK

SEQ ID NO: 893743 - protein, 806 aa, Homo sapiens
MQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKILFIGDSTNRGIMYYLIERLNETLQEWQKVHGTKFYHNVNGGKTLISYSYYPQFWISPSLRPTFENALEHLLQRSRPLENTGQTVLVVGGVQWLNSNHLQIIHKVLKRENLLNILVIIKTLGIGFHLPVDGVHFLTQSEVQNLWKENLIILDTAKKHGYEVVDTFTITMGRYKEFLQGKCGCHFHEVVKSKLSKEYNFIKMKRSRNHIMGRYFSNQSKLQQGTVTNFRSPYHVRGPINQVCSEILLSRMCANKRTM

SEQ ID NO: 893744 - protein, 806 aa, Homo sapiens; identical to SEQ ID NO: 893743

SEQ ID NO: 893745 - protein, 436 aa, Homo sapiens
MQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWQFLSTRQIKNHCTNTNEGAKFEMQVAKIKQSVQMSTKVKNMENREKISMCQVDGMQENDEPMVDNSKANNRIEQTSRNECVGKSVDNGSPWKRCVPSSPKQGSPDDDIVSVNPWVEEGCDTKCEGIGVGG

SEQ ID NO: 893746 - protein, 628 aa, Homo sapiens
SSGSGSWEPRWRRRRQRQQQQQPVFGKGRQVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893747 - protein, 248 aa, Homo sapiens
MVWLLLCCACRVHSDVQRSSTDLGVFRNLVPPTCVHSLVTVGNWIFLFYDFTVIRWIESGRIQNNECSIIYTTHNTFELIVTNIKALTKPDPPKPSRLYQTVEAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893748 - protein, 617 aa, Homo sapiens
MLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893749 - protein, 648 aa, Homo sapiens
AHASGRRRQTAAAVSLHSGKTASCSHVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893750 - protein, 633 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEDLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893751 - protein, 632 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893752 - protein, 457 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKVNLTFSPPQYDLHLHRVLYFVRCFSIHYLIESPL

SEQ ID NO: 893753 - protein, 297 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLVRD

SEQ ID NO: 893754 - protein, 651 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893755 - protein, 191 aa, Homo sapiens
MSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHI

SEQ ID NO: 893756 - protein, 633 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNPEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893757 - protein, 550 aa, Homo sapiens
MPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 893758 - protein, 651 aa, Homo sapiens; identical to SEQ ID NO: 893754

SEQ ID NO: 893759 - protein, 298 aa, Homo sapiens
AAEWLVGAKMAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLERWI

SEQ ID NO: 893760 - protein, 662 aa, Homo sapiens [sequence omitted]

SEQ ID NO: 893761 - protein, 662 aa, Homo sapiens [sequence omitted]

SEQ ID NO: 893762 - protein, 199 aa, Homo sapiens
RPGASATTRSDCPAERGKESHLDTLSRAQLTQLFLASVLECPFYKGPKLLPKYQVKSFLTPCCSLETPVDSQLYRYVKIGLTNLLGARLYFAPKVLTPYCYTIDVEIKLDEEGFVLPSTANEDIHKRIALCIDGPKRFCSNSKHLLGKEAIKQRHLQLLGYQVVQIPYHEIGMLKSRRELVEYLQRKLFSQNTVHWLQE

SEQ ID NO: 893763 - protein, 608 aa, Homo sapiens [sequence omitted]

SEQ ID NO: 893764 - protein, 662 aa, Homo sapiens [sequence omitted]

SEQ ID NO: 893765 - protein, 206 aa, Homo sapiens [sequence omitted]

SEQ ID NO: 893766 - protein, 145 aa, Homo sapiens
RPGASATTRSDCPAERGKESHLDTLSRAQLTQLFLASVLECPFYKGPKLLPKYQVKSFLTPCCSLETPVDSQLYRYVKIGLTNLLGARLYFAPKVLTPYCYTIAFSPIDQCKVEGIKAKQRNEYRKIVFVRVSHEEFFLSSLTRC

SEQ ID NO: 893767 - protein, 568 aa, Homo sapiens [sequence omitted]

SEQ ID NO: 893768 - protein, 779 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893769 - protein, 513 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPGINGLSVSTN

SEQ ID NO: 893770 - protein, 811 aa, Homo sapiens
MKREWIQGQAWWLTPVIPALWEAETVTVWRIKMLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893771 - protein, 732 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893772 - protein, 765 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTMERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893773 - protein, 779 aa, Homo sapiens; identical to SEQ ID NO: 893768

SEQ ID NO: 893774 - protein, 837 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQAPPRSCPHQLYSSSIGQKFGFAVGKCWYLAKCGIISLSQMLLAQQIIQLSKKKEENGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893775 - protein, 433 aa, Homo sapiens
MYLPSPEERNYEFLQWYKDDLCALAFKVLHDKQRGPLVFMRIYSGTIKPQLAIHNINGNCTERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893776 - protein, 386 aa, Homo sapiens
MYLPSPEERNYEFLERISRLLLPFADQHVEIPSLTAGNIALTVGLKHTATGDTIVSSKSSALAAARRAEREGEKKHRQNNEAERLLLAGVEIPEPVFFCTIEPPSLSKQPDLEHALKCLQREDPSLKVRLDPDSGQTVLCGMGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893777 - protein, 245 aa, Homo sapiens
MGELHIEIIHDRIKREYGLETYLGPLQVAYRETILNSVRATDTLDRTLGDKRHLVTVEVEARPIETSSVMPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893778 - protein, 466 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVADLDDEFADLVLEEFSENFDLLPAEKLQTAIHRVTLAQTAVPVLCGSALKNKGIQPLLDAVTMYLPSPEERNYEFLERISRLLLPFADQHVEIPSLTAGNIALTVGLKHTATGDTIVSSKSSALAAARRAEREGEKKHRQNNEAERLLLAGVEIPEPVFFCTIEPPSLSKQPGINGLSVSTN

SEQ ID NO: 893779 - protein, 288 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASFKYAVESIREKLKAKPLLLQLPIGEAKTFKGVVDVVMKEKLLWNCNSNDGKDFERKPLLEMNDPELLKETTEARNALIEQVKYNE

SEQ ID NO: 893780 - protein, 176 aa, Homo sapiens
MPVIEFEYAESINEGLLKVSQEAIENGIHSACLQGPLLGSPIQDVAITLHSLTIHPGTSTTMISACVSRCVQKALKKADKQVLEPLMNLEVTVARDYLSPVLADLAQRRGNIQEIQTRQDNKVVIGFVPLAEIMGYSTVLRTLTSGSATFALELSTYQAMNPQDQNTLLNRRSGLT

SEQ ID NO: 893781 - protein, 204 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGARL

SEQ ID NO: 893782 - protein, 211 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTTTTERILYYSGYTRSLGDVDDGDTVTDFMAQERERGITIQSAAVTFDWKGYRVNLIDTPGHVDFTLEVERCLRVLDGAVAVFDASAGVEAQTLTVWRQADKHNIPRICFLNKMDKTGASCSSMKLLL

SEQ ID NO: 893783 - protein, 110 aa, Homo sapiens
TARANKITVRFHSDQSYTDTGFLAEYLSYDSSDREMNIVGRRAGGGLHRMFCPPCISLASCFADSYCGERSQFVVTSNSNKITVRFHSDQSYTDTGFLAEYLSYDSSDRE

SEQ ID NO: 893784 - protein, 855 aa, Homo sapiens [sequence omitted]

SEQ ID NO: 893785 - protein, 757 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGG

SEQ ID NO: 893786 - protein, 462 aa, Homo sapiens
MLPCAFNVRWVLAWVYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 893787 - protein, 855 aa, Homo sapiens [sequence omitted]

SEQ ID NO: 893788 - protein, 128 aa, Homo sapiens
VVGLPQRRRTSCRSRTPRMMCVTGETAALRGTSQACTQGSLCFGTGSKRTLGYRGRGHPNVYTCGATHRPPQCARLQAGDWTADCTSAPRTYTVNSISRAPNLPRKPLASSASKVELGGRRGGHWWFY

SEQ ID NO: 893789 - protein, 601 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSSQNVLLITLITNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLVTLITNTGEARTLARLGHWRGQDTGEARTLARLGHWRGQDTGEARTLARARTLARLG

SEQ ID NO: 893790 - protein, 92 aa, Homo sapiens
MTLPSKQPGSQPRPALSPGTGALILQKGEIRVINQTTCENLLPQQITPRMMCVGFLSGGVDSCQVAPGAGGRQVGPGRGGTGDSRQGLSPPR

SEQ ID NO: 893791 - protein, 580 aa, Homo sapiens
QLGPTPPESMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 893792 - protein, 835 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSLNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPICLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 893793 - protein, 855 aa, Homo sapiens [sequence omitted]

SEQ ID NO: 893794 - protein, 686 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCWLMNSNSSASSGPENPDLVSLLLKCGADV

SEQ ID NO: 893795 - protein, 471 aa, Homo sapiens
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCLGQCCVWRSSAAVTGVDL

SEQ ID NO: 893796 - protein, 67 aa, Homo sapiens
TGGSTDPTGGKGLKTQPPPPAPSWAEARLCISASPVCKEQRERSFGASSVKVVGLPDLGCGALGPRS

SEQ ID NO: 893797 - protein, 171 aa, Homo sapiens
AGGGASGEREGSRRKDKKGSGTGAYGGRSGTRRAGGCRMMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSTFPFSH

SEQ ID NO: 893798 - protein, 196 aa, Homo sapiens
AGGGASGEREGSRRKDKKGSGTGAYGGRSGTRRAGGCRMMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPRSVLEEMGLA

SEQ ID NO: 893799 - protein, 196 aa, Homo sapiens; identical to SEQ ID NO: 893798

SEQ ID NO: 893800 - protein, 196 aa, Homo sapiens; identical to SEQ ID NO: 893798

SEQ ID NO: 893801 - protein, 196 aa, Homo sapiens; identical to SEQ ID NO: 893798

SEQ ID NO: 893802 - protein, 196 aa, Homo sapiens; identical to SEQ ID NO: 893798

SEQ ID NO: 893803 - protein, 154 aa, Homo sapiens
MLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPRSVLEEMGLA

SEQ ID NO: 893804 - protein, 93 aa, Homo sapiens
SSHTLPKYLSKSSTYRWISSSVMSSETNTLAAVCELDIIFNFEKAYFILDEFLMGGDVQDTSKKSVLKAIEQADLLQEEDESPRSVLEEMGLA

SEQ ID NO: 893805 - protein, 254 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 893806 - protein, 327 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKVCPHSQLTSQPAPSQGSPEPAASYRLALPVGPRAQSDLAGLPWPPGAGRGLCPGVNKGRAGPLLFSLPLQSHEEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 893807 - protein, 290 aa, Homo sapiens
PVLLDTGHLPTPCPVLCACPCPNRFPFYFELKIAFVIWLLSPYTKGSSVLYRKFVHPTLSNKEKVCPHSQLTSQPAPSQGSPEPAASYRLALPVGPRAQSDLAGLPWPPGAGRGLCPGVNKGRAGPLLFSLPLQSHEEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 893808 - protein, 254 aa, Homo sapiens; identical to SEQ ID NO: 893805

SEQ ID NO: 893809 - protein, 335 aa, Homo sapiens
TSPLTAALGAPLPPRRLLQRLLLLLRLLLPPPPPLGLRQLHPRPGRVPAPRRARPRHGVLDHLSPGGGLMRSWEGEATALAERPSNHACLPRLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 893810 - protein, 254 aa, Homo sapiens; identical to SEQ ID NO: 893805

SEQ ID NO: 893811 - protein, 355 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKVRWGQAQTPRAPTLYKGPWPGPFASTLYSGLLETLGSCSWRLQSRLYCYLAESLGLSGHFPICPQRQSVALPQPSALSVWDWVRTVWGGHRAWGCCQHHGDGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 893812 - protein, 216 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 893813 - protein, 254 aa, Homo sapiens; identical to SEQ ID NO: 893805

SEQ ID NO: 893814 - protein, 254 aa, Homo sapiens; identical to SEQ ID NO: 893805

SEQ ID NO: 893815 - protein, 170 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKVRWGQAQTPRAPTLYKGPWPGPFASTLYSGL

SEQ ID NO: 893816 - protein, 364 aa, Homo sapiens [sequence omitted]

SEQ ID NO: 893817 - protein, 134 aa, Homo sapiens [sequence omitted]

SEQ ID NO: 893818 - protein, 364 aa, Homo sapiens [sequence omitted]

SEQ ID NO: 893819 - protein, 364 aa, Homo sapiens [sequence omitted]

SEQ ID NO: 893820 - protein, 364 aa, Homo sapiens [sequence omitted]

SEQ ID NO: 893821 - protein, 364 aa, Homo sapiens [sequence omitted]

SEQ ID NO: 893822 - protein, 364 aa, Homo sapiens [sequence omitted]

SEQ ID NO: 893823 - protein, 593 aa, Homo sapiens
DSGGQWRGPRCPAVTKSWRHHLPPRVMAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 893824 - protein, 114 aa, Homo sapiens
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHKVGSTACSL

SEQ ID NO: 893825 - protein, 589 aa, Homo sapiens
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 893826 - protein, 567 aa, Homo sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 893827 - protein, 95 aa, Homo sapiens
PRSRLPTPQGSLKRATSCERAGKAVGEEVSGYSLHGCSKERRRRPRLKKEGGSGERRRETHLVPSTSGHPSWSSTFIPSVAVRRLNQGPEKVEES

SEQ ID NO: 893828 - protein, 528 aa, Homo sapiens
GGGACSLCSGSPPAPAPPASPARHVTRTARGHLEGGSRAPPLLQAVFLQIKNMVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARSTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 893829 - protein, 389 aa, Homo sapiens
MLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARSTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 893830 - protein, 528 aa, Homo sapiens; identical to SEQ ID NO: 893828

SEQ ID NO: 893831 - protein, 481 aa, Homo sapiens
GGGACSLCSGSPPAPAPPASPARHVTRTARGHLEGGSRAPPLLQAVFLQIKNMVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARSTEHQLKQFTEDWSEEDVSTWLCAQDLKDLVGIFKMNNIDGKELLNLTKESLADDLKIDGYSYEKEAMENWISKKKRTSPMTNLVLPSAVLTPNRTLKMAINRWLETHQK

SEQ ID NO: 893832 - protein, 497 aa, Homo sapiens
GGGACSLCSGSPPAPAPPASPARHVTRTARGHLEGGSRAPPLLQAVFLQIKNMVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSGFELKYKSTLSGHCAPVLACAFSHDGQMLVSGSVDKSVIVYDTNTENILHTLTQHTRYVTTCAFAPNTLLLATGSMDKTVNIWQFDLETLCQARSTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 893833 - protein, 528 aa, Homo sapiens; identical to SEQ ID NO: 893828

SEQ ID NO: 893834 - protein, 80 aa, Homo sapiens
SHGQEAERATCAAKDSRLAAAEEASVESLVPPALRGLVRPHKKRKKLSSSCRKAKRAKSQNPLRSFKHKGKKFRPTAKPS

SEQ ID NO: 893835 - protein, 573 aa, Homo sapiens
MVVALLPLASVAFFLQRVRAALLSSAMEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 893836 - protein, 547 aa, Homo sapiens
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 893837 - protein, 547 aa, Homo sapiens; identical to SEQ ID NO: 893836

SEQ ID NO: 893838 - protein, 547 aa, Homo sapiens; identical to SEQ ID NO: 893836

SEQ ID NO: 893839 - protein, 573 aa, Homo sapiens; identical to SEQ ID NO: 893835

SEQ ID NO: 893840 - protein, 573 aa, Homo sapiens; identical to SEQ ID NO: 893835

SEQ ID NO: 893841 - protein, 573 aa, Homo sapiens; identical to SEQ ID NO: 893835

SEQ ID NO: 893842 - protein, 436 aa, Homo sapiens
MVVALLPLASVAFFLQRVRAALLSSAMEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEGDQGRASAF

SEQ ID NO: 893843 - protein, 363 aa, Homo sapiens
MVVALLPLASVAFFLQRVRAALLSSAMEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQDFHHVSAVLNFDLPPTPEAYIHRAGRMPCAQ

SEQ ID NO: 893844 - protein, 410 aa, Homo sapiens
MVVALLPLASVAFFLQRVRAALLSSAMEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGSSVTAQASAW

SEQ ID NO: 893845 - protein, 227 aa, Homo sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 893846 - protein, 227 aa, Homo sapiens; identical to SEQ ID NO: 893845

SEQ ID NO: 893847 - protein, 227 aa, Homo sapiens; identical to SEQ ID NO: 893845

SEQ ID NO: 893848 - protein, 227 aa, Homo sapiens; identical to SEQ ID NO: 893845

SEQ ID NO: 893849 - protein, 227 aa, Homo sapiens; identical to SEQ ID NO: 893845

SEQ ID NO: 893850 - protein, 227 aa, Homo sapiens; identical to SEQ ID NO: 893845

SEQ ID NO: 893851 - protein, 227 aa, Homo sapiens; identical to SEQ ID NO: 893845

SEQ ID NO: 893852 - protein, 227 aa, Homo sapiens; identical to SEQ ID NO: 893845

SEQ ID NO: 893853 - protein, 186 aa, Homo sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRASAYLLVI

SEQ ID NO: 893854 - protein, 71 aa, Homo sapiens
RLLCNYNSHLYNLICRGVFNLPPALRGLVRPHKKRKKLSSSCRKAKRAKSQNPLRSFKHKGKKFRPTAKPS

SEQ ID NO: 893855 - protein, 186 aa, Homo sapiens; identical to SEQ ID NO: 893853

SEQ ID NO: 893856 - protein, 211 aa, Homo sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTHTQPYTHS

SEQ ID NO: 893857 - protein, 111 aa, Homo sapiens
AGPLRAMGRQALLLLALCATGAQGLYFHIGETEKRCFIEEIPDETMVIGQGAEGGEALCTQLSPRRRSLLPSPAGSLAPPVPSLRVPRGRQAPCLELRAARRRGPGGEAAH

SEQ ID NO: 893858 - protein, 103 aa, Homo sapiens
NYRTQMWDKQKEVFLPSTPGLGMHVEVKDPDGKVRLALAHAAVLQWSSRGVLSTAWRRPQGTGTCTWRACGIKVGPSLTYVAGGAVPAVRLGGPLHVHLPHAR

SEQ ID NO: 893859 - protein, 1255 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMLPPPTEQAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893860 - protein, 1255 aa, Homo sapiens; identical to SEQ ID NO: 893859

SEQ ID NO: 893861 - protein, 1301 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893862 - protein, 1366 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEQPCEEGIVILMLRISWERQQQAVTGARSWRVTHSALPHGADGHQTGDFQQSVGFASLKLRAELSLLLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893863 - protein, 1395 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEQPCEEGIVILMLRISWERQQQAVTGARSWRGHTQLCHMVLMDIRRRLPAICWFCKSEAPGRAEPGIQCAIPVHGRPGGCPAPLSLGSNDPLLPQLLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893864 - protein, 1321 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEEFLVWQRTQRTPQLEQGVIPLLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893865 - protein, 1263 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLASSFQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893866 - protein, 1005 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIIHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVEVPTGAAGTQRELLPGLGSRHWSFLLCKQYFIVYKAFPWA

SEQ ID NO: 893867 - protein, 871 aa, Homo sapiens
MIKKIMRQIQEEPLDSLSSSVRKQAMEILTQLSHTQPTLGMRERSELVNVCAHSVFSLPSVQAMQEKDEAKAETIQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893868 - protein, 803 aa, Homo sapiens
AWSSSHPQALYHQTLEALQTLLKALFIEDPTPAGLKSILEALGPWMNSGKAHERARAVNTNVSVLNHMLLTLPFFIEYKQMPLGFPALGLLLGRLILRIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREDVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAALDNLRHDPEASVCIYAAQVQDHILASCWQNSWLPHGNSWVCYSATTHRWSPSCENLPTSHQRRSWIMQALGSWKMSLKK

SEQ ID NO: 893869 - protein, 441 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEDGVSLCCPGWSVMAQSRLTATSTFGVQAILL

SEQ ID NO: 893870 - protein, 570 aa, Homo sapiens
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHRSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSDGISLHSSTHGPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCAHSVFSLPSVQAMQEKDEAKAETIQALYHQTLEALQTLLKALFIEDPTPAGLKSILEGPAPA

SEQ ID NO: 893871 - protein, 502 aa, Homo sapiens [sequence omitted]

SEQ ID NO: 893872 - protein, 247 aa, Homo sapiens
SETSLSGAMPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893873 - protein, 247 aa, Homo sapiens; identical to SEQ ID NO: 893872

SEQ ID NO: 893874 - protein, 281 aa, Homo sapiens
STEEVDSWTASDGGSSIRRGSVTDGWMQHEEVDMHHEEVVTTEEVDSTEEVDSTVVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893875 - protein, 247 aa, Homo sapiens; identical to SEQ ID NO: 893872

SEQ ID NO: 893876 - protein, 246 aa, Homo sapiens
MGTMRSRRLAMGMLLRRGIEPLRKRHLRRPMKIRFRFTFPGCRALSPWRVRVQRRRCEMSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893877 - protein, 104 aa, Homo sapiens
MVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893878 - protein, 176 aa, Homo sapiens
MESIAEFSLVSGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893879 - protein, 293 aa, Homo sapiens
SETSLSGAMPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIDRVSPYRPGWSTVTRFMAHCSLKLLGSSNPPTVASQVAGTTGAHHHERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893880 - protein, 102 aa, Homo sapiens
MVEWWQSFLLPLFLTSKDCLIEICWEMTPQTVPSFSCIFSVLCRFDRTFRRFSALPLHEPPPSRQVDFLAHHLLLGSSLELKNSLFSIILSRHTHIRLATVL

SEQ ID NO: 893881 - protein, 338 aa, Homo sapiens
SETSLSGAMPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSTNLVDNRRRKYERQEEKLKNNYRDLSMVRMKSMFAIGFCFTALMGTIYSIFDLRLVAKLSQYHSRGHPMTLYFLNRDCEQIYPPIYAVLCRENCAQDLHASAPGYELSACPF

SEQ ID NO: 893882 - protein, 247 aa, Homo sapiens; identical to SEQ ID NO: 893872

SEQ ID NO: 893883 - protein, 188 aa, Homo sapiens
MSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 893884 - protein, 247 aa, Homo sapiens; identical to SEQ ID NO: 893872

SEQ ID NO: 893885 - protein, 247 aa, Homo sapiens; identical to SEQ ID NO: 893872

SEQ ID NO: 893886 - protein, 188 aa, Homo sapiens; identical to SEQ ID NO: 893883

SEQ ID NO: 893887 - protein, 104 aa, Homo sapiens; identical to SEQ ID NO: 893877

SEQ ID NO: 893888 - protein, 102 aa, Homo sapiens; identical to SEQ ID NO: 893880

SEQ ID NO: 893889 - protein, 120 aa, Homo sapiens
MESKEELAANNLNGENAQQENEGGEQAPTQNEEESRHLGGGEGQKPGGNIRRGRVRRLVPNFRWAIPNRHIEHNEARDDVERFVGQMMEIKRKTREQQMRHYMRFQTPEPDNHYDFCLIP

SEQ ID NO: 893890 - protein, 170 aa, Homo sapiens
DRPTLSVVSLWRQSRRGSFHSRRWYLLPVALRTCGPGAAPKLGSGGGAGVMESKEELAANNLNGENAQQENEGGEQAPTQNEEESRHLGGGEGQKPGGNIRRGRVRRLVPNFRWAIPNRHIEHNEARDDVERFVGQMMEIKRKTREQQMRHYMRFQTPEPDNHYDFCLIP

SEQ ID NO: 893891 - protein, 93 aa, Homo sapiens
VTGHTECCLALASEPSWLVPFSAVVPAPGGPEDVWARGGPEIRKRRGSSLQVCGAKCRGGAPRVKNPEEETARIGPGVMESKEELAANNLSCL

SEQ ID NO: 893892 - protein, 120 aa, Homo sapiens; identical to SEQ ID NO: 893889

SEQ ID NO: 893893 - protein, 120 aa, Homo sapiens; identical to SEQ ID NO: 893889

SEQ ID NO: 893894 - protein, 120 aa, Homo sapiens; identical to SEQ ID NO: 893889

SEQ ID NO: 893895 - protein, 136 aa, Homo sapiens
RQRTQKDGDAKIGPGVMESKEELAANNLNGENAQQENEGGEQAPTQNEEESRHLGGGEGQKPGGNIRRGRVRRLVPNFRWAIPNRHIEHNEARDDVERFVGQMMEIKRKTREQQMRHYMRFQTPEPDNHYDFCLIP

SEQ ID NO: 893896 - protein, 646 aa, Homo sapiens
MTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 893897 - protein, 66 aa, Homo sapiens
HFEHVKSLLFANRRRKKAPTIKLWSSVGEVMASQDDPLGQPNSFTNHPGLGTNRKSRLFVKKRASD

SEQ ID NO: 893898 - protein, 77 aa, Homo sapiens
CIECCLRGNPIPPQLEPLAPLRRQRRKKAPTIKLWSSVGEVMASQDDPLGQPNSFTNHPGLGTNRKSRLFVKKRASD

SEQ ID NO: 893899 - protein, 66 aa, Homo sapiens; identical to SEQ ID NO: 893897

SEQ ID NO: 893900 - protein, 646 aa, Homo sapiens; identical to SEQ ID NO: 893896

SEQ ID NO: 893901 - protein, 646 aa, Homo sapiens; identical to SEQ ID NO: 893896

SEQ ID NO: 893902 - protein, 646 aa, Homo sapiens; identical to SEQ ID NO: 893896

SEQ ID NO: 893903 - protein, 646 aa, Homo sapiens; identical to SEQ ID NO: 893896

SEQ ID NO: 893904 - protein, 695 aa, Homo sapiens
MFRIPPHDTIVERKKLEGPCVLQIQKIRNVAAPKDNEESQAAPRMLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 893905 - protein, 766 aa, Homo sapiens
PSVSSGLILPSLRWPPVGAANATLLLYEEPPRDFPRYLSDEGIEACTSSPDKVNVNDIILIALNLEGPCVLQIQKIRNVAAPKDNEESQAAPRMLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQFGRRNSQDKRKCEVLWCDAMLMKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWEEEGTYDQTLEFRRGGDGQPRRSTRPTQQFYQPPRARN

SEQ ID NO: 893906 - protein, 95 aa, Homo sapiens
TEGPLGRIRFRGGCGFYRAEVEALHSSGMTAVVKFIDYGNYEEVLLSNIKPIQTEAWEEEGTYDQTLEFRRGGDGQPRRSTRPTQQFYQPPRARN

SEQ ID NO: 893907 - protein, 116 aa, Homo sapiens [sequence omitted]

SEQ ID NO: 893908 - protein, 646 aa, Homo sapiens; identical to SEQ ID NO: 893896

SEQ ID NO: 893909 - protein, 75 aa, Homo sapiens
FYFRFPAPRRQRLCATLCVQRYRRKKAPTIKLWSSVGEVMASQDDPLGQPNSFTNHPGLGTNRKSRLFVKKRASD

SEQ ID NO: 893910 - protein, 73 aa, Homo sapiens
VGGDTVYEVKGGGAGRRWNSGRKKAPTIKLWSSVGEVMASQDDPLGQPNSFTNHPGLGTNRKSRLFVKKRASD

SEQ ID NO: 893911 - protein, 77 aa, Homo sapiens
PPATRHTKRGRRGESRSLKHLWGTRRKKAPTIKLWSSVGEVMASQDDPLGQPNSFTNHPGLGTNRKSRLFVKKRASD

SEQ ID NO: 893912 - protein, 646 aa, Homo sapiens; identical to SEQ ID NO: 893896

SEQ ID NO: 893913 - protein, 646 aa, Homo sapiens; identical to SEQ ID NO: 893896

SEQ ID NO: 893914 - protein, 646 aa, Homo sapiens; identical to SEQ ID NO: 893896

SEQ ID NO: 893915 - protein, 646 aa, Homo sapiens; identical to SEQ ID NO: 893896

SEQ ID NO: 893916 - protein, 134 aa, Homo sapiens
PVSLLRPYPALSEVAACGRCKRHTFALRRTSSRLSKVCNSEKRPPKQVKAFGEEAKSLNRPDSSHQPVFGGSGPGAPQPGSPTPGRPLRPLRKRGERNPHAEAPAALSMPSCRADQRSFFFSFLFFFLRGGGLK

SEQ ID NO: 893917 - protein, 265 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 893918 - protein, 107 aa, Homo sapiens
SPSFFLSFFSSLFFPFFSLLSLFLSSISSPPLSLPLLSLFLSSLSLAFFSLSCLGCCGLQVGCCCCGPSQKLPVEGSLGILMLTLVVTQRKYWGHWRAHPHSPESPL

SEQ ID NO: 893919 - protein, 163 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRCQKPMPEAQPKVA

SEQ ID NO: 893920 - protein, 265 aa, Homo sapiens; identical to SEQ ID NO: 893917

SEQ ID NO: 893921 - protein, 265 aa, Homo sapiens; identical to SEQ ID NO: 893917

SEQ ID NO: 893922 - protein, 265 aa, Homo sapiens; identical to SEQ ID NO: 893917

SEQ ID NO: 893923 - protein, 265 aa, Homo sapiens; identical to SEQ ID NO: 893917

SEQ ID NO: 893924 - protein, 245 aa, Homo sapiens
MIERNRQRDGARRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 893925 - protein, 222 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQTRLRWRNLLKSMEMLLASQ

SEQ ID NO: 893926 - protein, 247 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRTFIGLEVTSGHAQFLDLVSEVDRVMEEFNLTTFYQDPSFHLSLAWCVGDARLQLEGQCLQELQAIVDGFEDAEVLLRVHTEQVRCKSGNKFFSMPLK

SEQ ID NO: 893927 - protein, 265 aa, Homo sapiens; identical to SEQ ID NO: 893917

SEQ ID NO: 893928 - protein, 265 aa, Homo sapiens; identical to SEQ ID NO: 893917

SEQ ID NO: 893929 - protein, 265 aa, Homo sapiens; identical to SEQ ID NO: 893917

SEQ ID NO: 893930 - protein, 216 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHRFFFTANQVKIYTNQEKTRTFIGLEVTSGHAQFLDLVSEVDRVMEEFNLTTFYQVMNGAAASPLTHF

SEQ ID NO: 893931 - protein, 216 aa, Homo sapiens; identical to SEQ ID NO: 893930

SEQ ID NO: 893932 - protein, 163 aa, Homo sapiens; identical to SEQ ID NO: 893919

SEQ ID NO: 893933 - protein, 186 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYEAKEEFLDLLDVLLPHAQTYVPRLVRMKVFHLSLSQSVVLRHHWILPFVQALKARMTSFHSPHPGPHCLIGTKDAPVTQEIPKDLGALRQEPGSQTR

SEQ ID NO: 893934 - protein, 203 aa, Homo sapiens
MSAAPLVGYSSSGSEDESEDGMRTRPGDGSHRRGQSPLPRQRFPVPDSVLNMFPGTEEGPEDDSTKHGGRVRTFPHERGNWATHVYVPYPRRSYWRGSDLQELQDNRGVGLNDAERAAARCTLDTQRPLQCLGTTFLPRCLSNAEHQQAFHPSKGTYIHDPVLADCDGGQSNHSHVGDCLHRPDPRTCSAPKRMTYRTLATAE

SEQ ID NO: 893935 - protein, 150 aa, Homo sapiens [sequence omitted]

SEQ ID NO: 893936 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 893937 - protein, 116 aa, Homo sapiens
AAAVGPCRPAAGADSGGRRTCTMARGSLRRLLRLLVLGLWLALLRSVAGEQAPGAAAPPAPFRLLWPILGGALSLTFVLGLLSGFLVWRRCRRREKFTTPIEETGGEGCPAVALIQ

SEQ ID NO: 893938 - protein, 129 aa, Homo sapiens; identical to SEQ ID NO: 893936

SEQ ID NO: 893939 - protein, 129 aa, Homo sapiens; identical to SEQ ID NO: 893936

SEQ ID NO: 893940 - protein, 129 aa, Homo sapiens; identical to SEQ ID NO: 893936

SEQ ID NO: 893941 - protein, 98 aa, Homo sapiens
AYYYYKLAAARSEPDLRAGAAFWLFGLETMPQEREVHHPHRGDRRRGLPSCGADPVTMCPLPAGARPLIIHSSILEPVSASQTRREPSSSNHKGGGGR

SEQ ID NO: 893942 - protein, 134 aa, Homo sapiens
GGGRGSLPAGGGRRQRRAQDVHYGSGLAAPVAAAPRAGALAGVAALRGRGASARHRPLLPRQLLERGPGQVHGLRVLQGATAQRLLPGLDPVTMCPLPAGARPLIIHSSILEPVSASQTRREPSSSNHKGGGGR

SEQ ID NO: 893943 - protein, 129 aa, Homo sapiens; identical to SEQ ID NO: 893936

SEQ ID NO: 893944 - protein, 172 aa, Homo sapiens
NKHSRGRVLIGQGALWLGARCAGCCGSSCWGSGWRCCAPWPGSKRQVRGTPGSGNPGPGLGSRTGCLENSAELGEQADVGIWGQVAFKQLAPGCGKFHHSPSFIHNPGLSFSHRPIGVGGVFSSTSPKYFEWREKVSEGGMFSLGRGTPPAWSVQGLTSPSDRRVGEAVERH

SEQ ID NO: 893945 - protein, 34 aa, Homo sapiens
EGAGDSRYSSRPTLTSDPRIAESRPQPLTRGPLP

SEQ ID NO: 893946 - protein, 322 aa, Homo sapiens; identical to SEQ ID NO: 743119

SEQ ID NO: 893947 - protein, 322 aa, Homo sapiens; identical to SEQ ID NO: 743119

SEQ ID NO: 893948 - protein, 322 aa, Homo sapiens; identical to SEQ ID NO: 743119

SEQ ID NO: 893949 - protein, 322 aa, Homo sapiens; identical to SEQ ID NO: 743119

SEQ ID NO: 893950 - protein, 360 aa, Homo sapiens
MFVHVLSSCMLCVSLVTSVSLDQKSDAICAGCASACRLTCCCVMVCHAMSWHPICACCVVHVVHACGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 893951 - protein, 322 aa, Homo sapiens; identical to SEQ ID NO: 743119

SEQ ID NO: 893952 - protein, 322 aa, Homo sapiens; identical to SEQ ID NO: 743119

SEQ ID NO: 893953 - protein, 312 aa, Homo sapiens [sequence omitted]

SEQ ID NO: 893954 - protein, 322 aa, Homo sapiens; identical to SEQ ID NO: 743119

SEQ ID NO: 893955 - protein, 322 aa, Homo sapiens; identical to SEQ ID NO: 743119

SEQ ID NO: 893956 - protein, 322 aa, Homo sapiens; identical to SEQ ID NO: 743119

SEQ ID NO: 893957 - protein, 322 aa, Homo sapiens; identical to SEQ ID NO: 743119

SEQ ID NO: 893958 - protein, 220 aa, Homo sapiens
MPAAVAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 893959 - protein, 282 aa, Homo sapiens
MSSLGGGSVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 893960 - protein, 103 aa, Homo sapiens
LEKARGSHAAISAPLWQGPSLCPQMQQPSWSARPGYKSIFSACSPCPCPRPSMSGLDANVQNGWKTTVVYPSHGLLVTLPQPQPHPSISALLCTHKGTHFSPV

SEQ ID NO: 893961 - protein, 260 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFRALMWGGKIQLTRAWE

SEQ ID NO: 893962 - protein, 821 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 893963 - protein, 821 aa, Homo sapiens; identical to SEQ ID NO: 893962

SEQ ID NO: 893964 - protein, 821 aa, Homo sapiens; identical to SEQ ID NO: 893962

SEQ ID NO: 893965 - protein, 800 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGAWLELC

SEQ ID NO: 893966 - protein, 821 aa, Homo sapiens; identical to SEQ ID NO: 893962

SEQ ID NO: 893967 - protein, 581 aa, Homo sapiens
MEARVNRPRVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 893968 - protein, 453 aa, Homo sapiens
MYEEIPGFNFSHGALFEMDMITVPAWLADPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 893969 - protein, 419 aa, Homo sapiens
PVVKRPVVETALGLNSSSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 893970 - protein, 593 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKVTYPFVLG

SEQ ID NO: 893971 - protein, 427 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLNLWEPRMRNCHCVLSFPGAYL

SEQ ID NO: 893972 - protein, 304 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFSGPWGVPRFQLHRPWDYPAGWGQTRFGPAGGRLGAPGAPPCGGVARLTRGAVDPSLYGGV

SEQ ID NO: 893973 - protein, 260 aa, Homo sapiens; identical to SEQ ID NO: 893961

SEQ ID NO: 893974 - protein, 176 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRIRELTSSRIGLLTRISGQVVRTHPVHPELVSGTFLCLDCQTVIRDVEQQFKYTQPNICRNPVCANRFHTNTGFSTSFGVFPVPVKLEPNNV

SEQ ID NO: 893975 - protein, 103 aa, Homo sapiens
SESDLIYLLLKKSYFCLDSDLEVEARREESLRLFAICSWFSLASFILLARVVAAEEMGKFMKPGKVVLVLAGRYSGRKAVIVKKNIDDGTSDRPLQPCSGGWN

SEQ ID NO: 893976 - protein, 74 aa, Homo sapiens
PHRGERLAEVSFFPFCCRPGWLLPKRTLMMAPQIAPYSHALVAGIDRYPRKVTACHGQEEDRQEIKDKIFCESV

SEQ ID NO: 893977 - protein, 118 aa, Homo sapiens
LLRVLHLEEVALGRESGDGAVVAHSGGGGLGSFRRDFPKRTLTACAHPRLPGPIRPRPNPWGRVLRCPAAEMGKFMKPGKVVLVLAGRYSGRKAVIVKKNIDDGTSDRPLQPCSGGWN

SEQ ID NO: 893978 - protein, 80 aa, Homo sapiens
EWYQHRGPITAGKSGINPEWPITAGSSGINAELPITAGGLFAVGPGGCCRNGQVHETWEGGACPGWTLLRTQSCHREEEH

SEQ ID NO: 893979 - protein, 258 aa, Homo sapiens
MARGRAEKRGHAKWANGPKGSVPENPSFLGAQRGDKICAGDTPYKEKSAYIHFRNNARGYPGFESRRNKTKTPTTKHHTKNHPRTTTNNDNDHKTDDDNRTKAHKHTTHNPPTENTRTTHATQQQNYTQTHNTTQDQANDQLREASQAANKHNSGHRRHEEKHERRAEQLRTPTKRKNNEEDSARREDKTRRRKEEKEKKKDDDTTNTQNRSRREEDQGNHEKQKTKREGAKTRGDGRSQRETRARHTKHERDGEKKM

SEQ ID NO: 893980 - protein, 122 aa, Homo sapiens
MKSGHTIAHSAQGIAAGGHQQVGGQWPQDFLAGQGQLQAQGSRGQGHPGGAQDRYVPKATALISSWSLREKEAMLPSTPRLPFPARPGWLLPKVEAWVESFNLLPSAAWGSKVRAAPGAFLP

SEQ ID NO: 893981 - protein, 80 aa, Homo sapiens; identical to SEQ ID NO: 893978

SEQ ID NO: 893982 - protein, 122 aa, Homo sapiens; identical to SEQ ID NO: 893980

SEQ ID NO: 893983 - protein, 80 aa, Homo sapiens
MEETPLLNGNANEENGEQEADNEVDEEEEEGGEEEDEEEEGDGEEEDGDEDEEAEVSYGQRAVKMMRMTMSIQEARREMI

SEQ ID NO: 893984 - protein, 258 aa, Homo sapiens
MARGRAEKRGHAKWANGPKGSVPENPSFLGAQRGDKICAGDTPYKEKSAYIHFRNNARGYPGFESRRNKTKTPTTKHHTKNHPRTTTNNDNDHKTDDDNRTKAHKHTTHNPPTENTRTTHATQQQNYTQTHNTTQDQANDQLREASQAANKHNSGHRRHEEKHERRAEQLRTPTYRKNNEEDSARREDKTRRRKEEKEKKKDDDTTNTQNRSRREEDQGNHEKQKTKREGAKTRGDGRSQRETRARHTKHERDGEKKM

SEQ ID NO: 893985 - protein, 122 aa, Homo sapiens; identical to SEQ ID NO: 893980

SEQ ID NO: 893986 - protein, 258 aa, Homo sapiens; identical to SEQ ID NO: 893979

SEQ ID NO: 893987 - protein, 140 aa, Homo sapiens
MKSGHTIAHSAQGIAAGGHQQVGGQWPQDFLEDKGSSRPKAPVVRATQVEPRIASPQSHCANFVMVTAREGSNAPLYPTSPLPRAARVVAAEEMGKFMKPGKVVLVLAGRYSGRKAVIVKKNIDDGTSDRPLQPCSGGWN

SEQ ID NO: 893988 - protein, 258 aa, Homo sapiens; identical to SEQ ID NO: 893979

SEQ ID NO: 893989 - protein, 258 aa, Homo sapiens
MARGRAEKRGHAKWANGPKGSVPENPSFLGAQRGDKICAGDTPYKEKSAYIHFRNNARGYPGFESRRNKTKTPTTKHHTKNHPRTTTNNDNDHKTDDDNRTKAHKHTTHNPPTENTRTTHATQQQNYTQQHNTTQDQANDQLREASQAANKHNSGHRRHEEKHERRAEQLRTPTKRKNNEEDSARREDKTRRRKEEKEKKKDDDTTNTQNRSRREEDQGNHEKQKTKREGAKTRGDGRSQRETRARHTKHERDGEKKM

SEQ ID NO: 893990 - protein, 140 aa, Homo sapiens; identical to SEQ ID NO: 893987

SEQ ID NO: 893991 - protein, 140 aa, Homo sapiens; identical to SEQ ID NO: 893987

SEQ ID NO: 893992 - protein, 170 aa, Homo sapiens
MKSGHTIAHSAQGIAAGGHQQVGGQWPQDFLEDKGSSRPKAPVVRATQVEPRIASPQSHCANFVMVTAREGSNAPLYPTSPLPRAARVVAAEEMGKFMKPGKVVLVLAGRYSGRKAVIVKKVLCGISPWTKLSSIRMSSEILLLNARPDGRAKVKFEREIQDRQEQVVLP

SEQ ID NO: 893993 - protein, 120 aa, Homo sapiens
TCNELRSHHCSPAWTKDSDSVSKKKKCEFSDNVIGTWLLMVASKESDPDSLVSHKDLGCIGAPAVCGLILPLHLCPKVLCGISPWTKLSSIRMSSEILLLNARPDGRAKVKFEREVSRLW

SEQ ID NO: 893994 - protein, 71 aa, Homo sapiens
PAALTRLRDRGVSPCCEARVVAAEMGKFMKPGKVVLVLAGRYSGRKAVIVKKNIDDGTSDRPLQPCSGGWN

SEQ ID NO: 893995 - protein, 105 aa, Homo sapiens
RPPTTTTARIQASNDVRGEMGKFMKPGKVVLVLAGRYSGRKAVIVKKVLCGISPWTKLSSIRMSSEILLLNARPDGRAKVKFEREIQDRQEQVVLPETAVLDALF

SEQ ID NO: 893996 - protein, 80 aa, Homo sapiens; identical to SEQ ID NO: 893983

SEQ ID NO: 893997 - protein, 258 aa, Homo sapiens
MARGRAEKRGHAKWANGPKGSVPENPSFLGAQRGDKICAGDTPYKEKSAYIHFRNNARGYPGFESRRNKTKTPTTKHHTKNHPRTTTNNDNDHKTDDDNRTKAHKHTTHNPPTENTRTTHATQQQNYTQTHNTTQDQANDQLREASQAANKHNSGHRRHEEKHERRAEQLRTPTKRKNNEEDSARREDKDETEKGRKREKKDDDTTNTQNRSRREEDQGNHEKQKTKREGAKTRGDGRSQRETRARHTKHERDGEKKM

SEQ ID NO: 893998 - protein, 140 aa, Homo sapiens; identical to SEQ ID NO: 893987

SEQ ID NO: 893999 - protein, 258 aa, Homo sapiens; identical to SEQ ID NO: 893979

SEQ ID NO: 894000 - protein, 122 aa, Homo sapiens; identical to SEQ ID NO: 893980

SEQ ID NO: 894001 - protein, 258 aa, Homo sapiens; identical to SEQ ID NO: 893979

SEQ ID NO: 894002 - protein, 258 aa, Homo sapiens; identical to SEQ ID NO: 893979

SEQ ID NO: 894003 - protein, 140 aa, Homo sapiens; identical to SEQ ID NO: 893987

SEQ ID NO: 894004 - protein, 73 aa, Homo sapiens
MGKKKIAKRSKIKSFVKVYNYNHLMPTRYSVGYPLGPTGGPRSSLNERYKTGKNKWFFQKLRFHKRFYRRRGR

SEQ ID NO: 894005 - protein, 140 aa, Homo sapiens; identical to SEQ ID NO: 893987

SEQ ID NO: 894006 - protein, 122 aa, Homo sapiens; identical to SEQ ID NO: 893980

SEQ ID NO: 894007 - protein, 96 aa, Homo sapiens
LLIFSSISWMGGKNPFLGIAYLVVGSLCILTGFVMLVVYIRYQDQDDDDEEWFRLSRDPSCFLPKLLQGAFGISSSPVTQFQPRLAFPPFVNEGTR

SEQ ID NO: 894008 - protein, 96 aa, Homo sapiens; identical to SEQ ID NO: 894007

SEQ ID NO: 894009 - protein, 96 aa, Homo sapiens; identical to SEQ ID NO: 894007

SEQ ID NO: 894010 - protein, 96 aa, Homo sapiens; identical to SEQ ID NO: 894007

SEQ ID NO: 894011 - protein, 96 aa, Homo sapiens; identical to SEQ ID NO: 894007

SEQ ID NO: 894012 - protein, 108 aa, Homo sapiens [sequence omitted]

SEQ ID NO: 894013 - protein, 341 aa, Homo sapiens
PGLSGPLPWERERWTQAAMSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVREELEAQLSCFRELLGRAPTHADGHQHVHVLPGVCQVFAEALQAYGVRFTRLPLERGVGGCTWLEAPARAFACAVERDARAAVGPFSRHGLRWTDAFVGLSTCGRHMSAHRVSGALARVLEGTLAGHTLTAELMAHPGYPSVPPTGGCGEGPDAFSCSWERLHELRVLTAPTLRAQLAQDGVQLCALDDLDSKRPGEEVPCEPTLEPFLEPSLL

SEQ ID NO: 894014 - protein, 406 aa, Homo sapiens
PGLSGPLPWERERWTQAAMSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVRSRSYRRMLARTPRAPPGGYCEAVRSWRWMTSAFKHWSHHTEARGGYPRQLLPVAQGVSRSPSEVREELEAQLSCFRELLGRAPTHADGHQHVHVLPGVCQVFAEALQAYGVRFTRLPLERGVGGCTWLEAPARAFACAVERDARAAVGPFSRHGLRWTDAFVGLSTCGRHMSAHRVSGALARVLEGTLAGHTLTAELMAHPGYPSVPPTGGCGEGPDAFSCSWERLHELRVLTAPTLRAQLAQDGVQLCALDDLDSKRPGEEVPCEPTLEPFLEPSLL

SEQ ID NO: 894015 - protein, 108 aa, Homo sapiens [sequence omitted]

SEQ ID NO: 894016 - protein, 108 aa, Homo sapiens [sequence omitted]

SEQ ID NO: 894017 - protein, 108 aa, Homo sapiens [sequence omitted]

SEQ ID NO: 894018 - protein, 108 aa, Homo sapiens [sequence omitted]

SEQ ID NO: 894019 - protein, 108 aa, Homo sapiens [sequence omitted]

SEQ ID NO: 894020 - protein, 167 aa, Homo sapiens
PGLSGPLPWERERWTQAAMSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVREELEAQLSCFRELLGRAPTHADGHQHVHVLPGGQTPSWA

SEQ ID NO: 894021 - protein, 199 aa, Homo sapiens
PGLSGPLPWERERWTQAAMSRPRMRLVVTADDFGYCPRRDEGIVEAFLAGAVTSVSLLVNGAATESAAELARRHSIPTGLHANLSEGRPVGPARRGASSLLGPEGFFLGKMGFREAVAAGDVDLPQVRSRSYRRMLARTPRAPPGGYCEAVRSWRWMTSAFKHWSHHTEARGGYPRQLLPVAQGVSRSPSRCGRSSRPN

SEQ ID NO: 894022 - protein, 108 aa, Homo sapiens [sequence omitted]

SEQ ID NO: 894023 - protein, 693 aa, Homo sapiens
MRACAGSTREAGSGAAQDLSTLLCLEESMEEQDEKPPEPPKVCAQDSFLPQEIIIKVEGEDTGSLTIPSQEGVNFKIVTVDFTREEQGTCNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKSYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 894024 - protein, 665 aa, Homo sapiens
MEEQDEKPPEPPKVCAQDSFLPQEIIIKVEGEDTGSLTIPSQEGVNFKIVTVDFTREEQGTCNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKSYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 894025 - protein, 535 aa, Homo sapiens
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPPSKRKVAE

SEQ ID NO: 894026 - protein, 450 aa, Homo sapiens
MRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPPSKRKVAE

SEQ ID NO: 894027 - protein, 103 aa, Homo sapiens
MPTSTTSPWFCWWASTPLGRPPSSGEPAQGPGSPPRSPAPSPSGHSWCSIPDRGPMGSPQLRALKRSVFVQASKSYPTIFAGPPSHPTQYLSTLLGPWLWWST

SEQ ID NO: 894028 - protein, 535 aa, Homo sapiens; identical to SEQ ID NO: 894025

SEQ ID NO: 894029 - protein, 528 aa, Homo sapiens
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDGSFFLYSPPIQLTRAGVTEGACLLMPPDA

SEQ ID NO: 894030 - protein, 131 aa, Homo sapiens
PGLVFTAVCPLLLEAQPLWPCVLQVLGDPQLRRPGAPGSLEMGPLQFRDVAIEFSLEEWHCLDTAQRNLYRNVMLENYRNLVFLGIVVSKPDLITCLEQRLQWGKIVRLHSSLGNKSKTLSQKKKSLLDYL

SEQ ID NO: 894031 - protein, 577 aa, Homo sapiens
PGLVFTAVCPLLLEAQPLWPCVLQVLGDPQLRRPGAPGSLEMGPLQFRDVAIEFSLEEWHCLDTAQRNLYRNVMLENYRNLVFLGIVVSKPDLITCLEQGKKPLTMKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRSSILTAHKIIHSGEKPYKCEECGKAFKHPSVLTTHKRIHTGEKPYKCEECGRAFKYFSSLTTHKIIHSGEKPYKCEECGKAFNWSSHLTTHKRIHTGEKPYKCEECGEAFKYSSSLTTHKIIHTGQQPFKCEECGKAFKCFSILTTHKRIHTGEKPYKCEECGKAFNSSSHLTAHKRIHTGEKPYKCERCGKAFKRSFILTRHKRIHTGEKPYKCEECGEGFKCPSTLTTHKVIHTGEKL

SEQ ID NO: 894032 - protein, 577 aa, Homo sapiens; identical to SEQ ID NO: 894031

SEQ ID NO: 894033 - protein, 535 aa, Homo sapiens
SRSCLHCCVSSAPRGPASVALCPAGIGRSTAKTPGSPWKPRNGIVVSKPDLITCLEQGKKPLTMKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRSSILTAHKIIHSGEKPYKCEECGKAFKHPSVLTTHKRIHTGEKPYKCEECGRAFKYFSSLTTHKIIHSGEKPYKCEECGKAFNWSSHLTTHKRIHTGEKPYKCEECGEAFKYSSSLTTHKIIHTGQQPFKCEECGKAFKCFSILTTHKRIHTGEKPYKCEECGKAFNSSSHLTAHKRIHTGEKPYKCERCGKAFKRSFILTRHKRIHTGEKPYKCEECGEGFKCPSTLTTHKVIHTGEKL

SEQ ID NO: 894034 - protein, 591 aa, Homo sapiens
PGLVFTAVCPLLLEAQPLWPCVLQVLGDPQLRRPGAPGSLEMGPLQFRDVAIEFSLEEWHCLDTAQRNLYRNVMLENYRNLVFLGIVVSKPDLITCLEQGKKPLTMKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRSSILTAHKIIHSGEKPYKCEECGKAFKHPSVLTTHKRIHTGEKPYKCEECGRAFKYFSSLTTHKIIHSGEKPYKCEECGKAFNWSSHLTTHKRIHTGEKPYKCEECGEAFKYSSSLTTHKIIHTGQQPFKCEECGKAFKCFSILTTHKRIHTGEKPYKCEECGKAFNSSSHLTAHKRIHTGEKPYKCERCGKAFKRSFILTRHKRIHTGEKPYKCEECGEGFKCPSTLTTHKFFVYCREVAVLLENCYSHLYPH

SEQ ID NO: 894035 - protein, 120 aa, Homo sapiens
PGLVFTAVCPLLLEAQPLWPCVLQVLGDPQLRRPGAPGSLEMGPLQFRDVAIEFSLEEWHCLDTAQRNLYRNVMLENYRNLVFLGIVVSKPDLITCLEQGKKPLTMKKHEMVANPSGRCK

SEQ ID NO: 894036 - protein, 183 aa, Homo sapiens
MTTASASQVRQNSHQDSEAAINRQINLELYASYVYLSMSYYFDRDDVALKNFAKYFLHQSHEEREHAEKLMELQNQLGGRIFLQDIKKPDCDDWESRLNATECALHLEKNVNQSLLELHKLATDKNDPHLCDFIETHYLNEQVKAIKELGDQVTNLRKMGAPESGLAEYLFDKHILGDSDNES

SEQ ID NO: 894037 - protein, 172 aa, Homo sapiens
TDRTEVIPLVLEVSIACSLASYVYLSMSYYFDRDDVALKNFAKYFLHQSHEEREHAEKLMELQNQLGGRIFLQDIKKPDCDDWESRLNATECALHLEKNVNQSLLELHKLATDKNDPHLCDFIETHYLNEQVKAIKELGDQVTNLRKMGAPESGLAEYLFDKHILGDSDNES

SEQ ID NO: 894038 - protein, 122 aa, Homo sapiens
ITALLMGIILMEKSKGKGQQLGSTPDESSGLGGVHVVLSLGRVRAAARVGPAVGVCSVEMGRKLEPGSSSHSLPAPAPRHHLLVGSALMPHLSLQRDLDFTIDLDFKGQLCELSCSTDYRMR

SEQ ID NO: 894039 - protein, 373 aa, Homo sapiens
TLEVPQRWSSAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894040 - protein, 89 aa, Homo sapiens
VDPPGCRIRPESPYTHWKQTVFYMEDYLTVKTGEEIFGTIGMRPNAQEQPGPGLHHRPGLQGPAVRAVLLHRLPDALRPGSPALHEPRG

SEQ ID NO: 894041 - protein, 99 aa, Homo sapiens
ITALLMGIILMEKSKGKGQQLGSTPDGTWTSPSTWTSRASCASCPAPPTTGCAEARLSRPARAQGLSVPRRFRGSPFLSLPPAEGGFRGLGWGDGEGTS

SEQ ID NO: 894042 - protein, 93 aa, Homo sapiens
MRPGHGGQQRQSPREKLTQRVEQTLGNCTNRQAKNRDITNATRKDRHLKTGNIERTHTNSCGPAAPQHREDKDSPRDAETAPQTTEPPRATRH

SEQ ID NO: 894043 - protein, 48 aa, Homo sapiens
LESPGVVWVGKVGPGRWVRGWVALRVVMECGPWDTHEPVTAAVVNWAV

SEQ ID NO: 894044 - protein, 38 aa, Homo sapiens
PPPPRTFATVCGNICGCHPYKDSCSPRDHGTSWETDTG

SEQ ID NO: 894045 - protein, 373 aa, Homo sapiens; identical to SEQ ID NO: 894039

SEQ ID NO: 894046 - protein, 366 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894047 - protein, 366 aa, Homo sapiens; identical to SEQ ID NO: 894046

SEQ ID NO: 894048 - protein, 385 aa, Homo sapiens
MAAAEAANCIMENFVATLANGMSLQPPLEEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894049 - protein, 373 aa, Homo sapiens; identical to SEQ ID NO: 894039

SEQ ID NO: 894050 - protein, 373 aa, Homo sapiens; identical to SEQ ID NO: 894039

SEQ ID NO: 894051 - protein, 373 aa, Homo sapiens; identical to SEQ ID NO: 894039

SEQ ID NO: 894052 - protein, 360 aa, Homo sapiens
MVGVAEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894053 - protein, 373 aa, Homo sapiens; identical to SEQ ID NO: 894039

SEQ ID NO: 894054 - protein, 367 aa, Homo sapiens
LVQIRHEEETGEMVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894055 - protein, 338 aa, Homo sapiens
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894056 - protein, 362 aa, Homo sapiens
MKSSSGVAVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894057 - protein, 338 aa, Homo sapiens; identical to SEQ ID NO: 894055

SEQ ID NO: 894058 - protein, 338 aa, Homo sapiens; identical to SEQ ID NO: 894055

SEQ ID NO: 894059 - protein, 360 aa, Homo sapiens; identical to SEQ ID NO: 894052

SEQ ID NO: 894060 - protein, 332 aa, Homo sapiens
MAAAEAANCIMEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894061 - protein, 387 aa, Homo sapiens
MVGVAEVSCGQAESSEKPNAEDMTSKDYYFDSYAHFGIHERRSRSVAQAESALVQSWLTAASTSPAQEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894062 - protein, 327 aa, Homo sapiens
VPVPSKAEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894063 - protein, 373 aa, Homo sapiens; identical to SEQ ID NO: 894039

SEQ ID NO: 894064 - protein, 356 aa, Homo sapiens
MHEECPKLLEGTMNNPKDFHSFDFHTHTFGIPRRMNAWMDRRVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894065 - protein, 335 aa, Homo sapiens
RHTFGNSNERADFATRNQMCLVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894066 - protein, 345 aa, Homo sapiens
TLEVPQRWSSAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPCKA

SEQ ID NO: 894067 - protein, 221 aa, Homo sapiens
MGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894068 - protein, 299 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKVRGWAWPGAPWVETKERPSPGPGMGLWGPECWPEVSEPDLPARGGARGPGKTLRPLNIFVSAAV

SEQ ID NO: 894069 - protein, 249 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKPEVVLEAQERHFVL

SEQ ID NO: 894070 - protein, 321 aa, Homo sapiens
TLEVPQRWSSAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMVRGLGWGDGEGTS

SEQ ID NO: 894071 - protein, 189 aa, Homo sapiens
MLNFYFSYVLIYIKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894072 - protein, 312 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894073 - protein, 196 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIH

SEQ ID NO: 894074 - protein, 161 aa, Homo sapiens
MSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAQEQPGPGLHHRPGLQGPAVRAVLLHRLPDALRPGSPALHEPRG

SEQ ID NO: 894075 - protein, 91 aa, Homo sapiens
ELGRGKTTEGCGPTPRTTGTWTSPSTWTSRASCASCPAPPTTGCAEARLSRPARAQGLSVPRRFRGSPFLSLPPAEGGFRGLGWGDGEGTS

SEQ ID NO: 894076 - protein, 97 aa, Homo sapiens
MAAAEAANCIMEVSCGQAESSEKPNAEDMTSKDYYFDSYAHFGIHEEMLKDEVRTLTYRNSMFHNRHLFKDKAHSSSLPSFPTPRKDRGGILKNGYD

SEQ ID NO: 894077 - protein, 195 aa, Homo sapiens
LGWKSGSRPMGARVGGTQGSHGMWTLGHPRACDSSSCQLGSFTAPSAPRPPPGRLPPSVETFVVVTPEKGWSWHLVGRGQGAGKCPAATGPPPTKTHAAPGTTALAGKRILEREEESSGVGDFVSSSCAGGYGGRRGSGDSRLDHCVSLERLPEEEVGLGEVFFFMKEAITALLMGIILMEKSKGKGQQLGSTPE

SEQ ID NO: 894078 - protein, 260 aa, Homo sapiens
SNISLYSVVSLRPLPADYVPSIVMLPGTCQTQDVEVSEETVEPSDELIEYDSPEQLNEQLVTLSLLPESRWKNLLNLDVIKKKNKPKEPPKVPKSAPFFIPTIPGLVPRYAAPEQNNDPQQSKVVNLGVLAQKSDFCLKLEEGLVNNKYDTALNLLKESGPSGIETELRSLSPDCGGSIEVMQSFLKMIGMMLDRKRDFELAQAYLALFLKLHLKMLPSEPVLLEEITNLSSQVEENWTHLQSLFNQSMCILNYLKSALL

SEQ ID NO: 894079 - protein, 433 aa, Homo sapiens
GGGWGEALSSPARGRSGGARASSPQRRGGGRRKMETHISCLFPELLAMIFGYLDVRDKGRAAQVCTAWRDAAYHKSVWRGVEAKLHLRRANPSLFPSLQARGIRRVQILSLRRSLSYVIQGMANIESLNLSGCYNLTDNGLGHAFVQEIGSLRALNLSLCKQITDSSLGRIAQYLKGLEVLELGGCSNITNTGLLLIAWGLQRLKSLNLRSCRHLSDVGIGHLAGMTRSAAEGCLGLEQLTLQDCQKLTDLSLKHISRGLTGLRLLNLSFCGGISDAGLLHLSHMGSLRSLNLRSCDNISDTGIMHLAMGSLRLSGLDVSFCDKVGDQSLAYIAQGLDGLKSLSLCSCHISDDGINRMVRQMHGLRTLNIGQCVRITDKGLELIAEHLSQLTGIDLYGCTRITKRGLERITQLPCLKVLNLGLWQMTDSEKVR

SEQ ID NO: 894080 - protein, 409 aa, Homo sapiens
GGGWGEALSSPARGRSGGARASSPQRRGGGRRKMETHISCLFPELLAMIFGYLDVRDKGRAAQVCTAWRDAAYHKSVWRGVEAKLHLRRANPSLFPSLQARGIRRVQILSLRRSLSYVIQGMANIESLNLSGCYNLTDNGLGHAFVQEIGSLRALNLSLCKQITDSSLGRIAQYLKGLEVLELGGCSNITNTGLLLIAWGLQRLKSLNLRSCRHLSDVGIGHLAGMTRSAAEGCLGLEQLTLQDCQKLTDLSLKHISRGLTGLRLLNLSFCGGISDAGLLHLSHMGSLRLSGLDVSFCDKVGDQSLAYIAQGLDGLKSLSLCSCHISDDGINRMVRQMHGLRTLNIGQCVRITDKGLELIAEHLSQLTGIDLYGCTRITKRGLERITQLPCLKVLNLGLWQMTDSEKVR

SEQ ID NO: 894081 - protein, 433 aa, Homo sapiens; identical to SEQ ID NO: 894079

SEQ ID NO: 894082 - protein, 434 aa, Homo sapiens
GGGWGEALSSPARGRSGGARASSPQRRGGGRRKMETHISCLFPELLAMIFGYLDVRDKGRAAQVCTAWRDAAYHKSVWRGVEAKLHLRRANPSLFPSLQARGIRRVQILSLRRSLSYVIQGMANIESLNLSGCYNLTDNGLGHAFVQEIGSLRALNLSLCKQITDSSLGRIAQYLKGLEVLELGGCSNITNTGLLLIAWGLQRLKSLNLRSCRHLSDVGIGHLAGMTRSAAEGCLGLEQLTLQDCQKLTDLSLKHISRGLTGLRLLNLSFCGGISDAGLLHLSHMGSLRSLNLRSCDNISDTGIMHLAMGSLRLSGLDVSFCDKVGDQSLAYIAQGLDGLKSLSLCSCHISDDGINRMVRQMHGLRTLNIGQCVRITDKGLELIAEHLSQLTGIDLYGCTRITKRGLERITQLPCLKVLNLGLWQMTDSEKGLL

SEQ ID NO: 894083 - protein, 757 aa, Homo sapiens
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 894084 - protein, 757 aa, Homo sapiens; identical to SEQ ID NO: 894083

SEQ ID NO: 894085 - protein, 305 aa, Homo sapiens
MCIFYGILVLMGTTSVGLRSGQPGLVLSLPTPYWPEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 894086 - protein, 190 aa, Homo sapiens
APPLSGSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 894087 - protein, 79 aa, Homo sapiens
YAQQRSGVNRPRGMKTSEHPVFKRYALPLFQQGYFPLHSDEGSFICFQNGARRTGVSCPLVNLSGATGLHKTESVSQYT

SEQ ID NO: 894088 - protein, 509 aa, Homo sapiens
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEERGDW

SEQ ID NO: 894089 - protein, 773 aa, Homo sapiens
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 894090 - protein, 269 aa, Homo sapiens
MKEVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 894091 - protein, 105 aa, Homo sapiens
REFNRGGVSPVQRSFHHGLHYLVRSELVSTRDPFIPNSNTKYTLNLKLFWFCYTHRVGGRDGTAHCWQGTGNSSKHGEGWRAGWGGSLLFKEAFTMGFIILSEVN

SEQ ID NO: 894092 - protein, 605 aa, Homo sapiens
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIERPRIRGRLNTSYSD

SEQ ID NO: 894093 - protein, 325 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 894094 - protein, 325 aa, Homo sapiens; identical to SEQ ID NO: 894093

SEQ ID NO: 894095 - protein, 324 aa, Homo sapiens
RVGAAVAFPTVGASASQSSDEPEQHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 894096 - protein, 340 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEGLGLLDVWGQLEKPFDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 894097 - protein, 181 aa, Homo sapiens
MICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 894098 - protein, 156 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEGLGLLDVWGQLESLSMKLF

SEQ ID NO: 894099 - protein, 146 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEGQYTYPLLR

SEQ ID NO: 894100 - protein, 197 aa, Homo sapiens
RVGAAVAFPTVGASASQSSDEPEQHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDSNAGSRKLVPREHDWKLYRYIPTRRHQGSVEGKYSFPAIILHSQFLQFAENFFLYKDIKS

SEQ ID NO: 894101 - protein, 356 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRCLCSKAVTGCVLWLMPVIPALWEANAGGSLEGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 894102 - protein, 188 aa, Homo sapiens
RVGAAVAFPTVGASASQSSDEPEQHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDSNAGSRKLVPREHDWKLYRYIPTRRHQGSVEGCGSNCSACCHRCRSRATSL

SEQ ID NO: 894103 - protein, 240 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFV

SEQ ID NO: 894104 - protein, 137 aa, Homo sapiens
MHTHHLPGVYDERNQKFYRQQRLPIPGSIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 894105 - protein, 288 aa, Homo sapiens
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGNLEGTSGSDGNVEDSDQSEKEPGQQYSRPQGAVGGLEPGNAQQPNVHAFTPLQLQELECIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 894106 - protein, 359 aa, Homo sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 894107 - protein, 402 aa, Homo sapiens
GAGRAGPGRAAPGARGPDTRRDMQGTLLWKLSVPGHWGGLRPTMPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 894108 - protein, 359 aa, Homo sapiens; identical to SEQ ID NO: 894106

SEQ ID NO: 894109 - protein, 148 aa, Homo sapiens [sequence omitted]

SEQ ID NO: 894110 - protein, 359 aa, Homo sapiens; identical to SEQ ID NO: 894106

SEQ ID NO: 894111 - protein, 359 aa, Homo sapiens; identical to SEQ ID NO: 894106

SEQ ID NO: 894112 - protein, 359 aa, Homo sapiens; identical to SEQ ID NO: 894106

SEQ ID NO: 894113 - protein, 487 aa, Homo sapiens
SLPSWLCMTKGKEQVSSLICPLPAPHTCLLVPPPQPRLREGKSKGGLGKGCVPALLDPARATVLSWRPRTKILPGLMTRSTRRPLPESLGTPTRESGAVSRGARGCARQGTLLWKLSVPGHWGGLRPTMPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 894114 - protein, 122 aa, Homo sapiens
AAALSYFSFSRSPTLRNSASCSQQVLRLQDPEDAVAFAGYVCHLIHSPATCLRNESTGSLGTQGRLCNKTSEGMDGCELMCCGRGYNQFKSVQVERCHCKFHWCCFVRCKKCTEIVDQYICK

SEQ ID NO: 894115 - protein, 308 aa, Homo sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTQ

SEQ ID NO: 894116 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 894117 - protein, 239 aa, Homo sapiens
MILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 894118 - protein, 239 aa, Homo sapiens; identical to SEQ ID NO: 894117

SEQ ID NO: 894119 - protein, 491 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQATSHCCHV

SEQ ID NO: 894120 - protein, 469 aa, Homo sapiens [sequence omitted]

SEQ ID NO: 894121 - protein, 760 aa, Homo sapiens; identical to SEQ ID NO: 894116

SEQ ID NO: 894122 - protein, 742 aa, Homo sapiens
MKTWVKIVFGVATSAVLALLVMCIVLRPSRVHNSEENTMRALTLKDILNGTFSYNNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 894123 - protein, 151 aa, Homo sapiens [sequence omitted]

SEQ ID NO: 894124 - protein, 251 aa, Homo sapiens
RSAEAAGTRFSSFPEAGPRPVRRRAGLARGQRRSAGVSSSGSEGAADAGRMYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 894125 - protein, 168 aa, Homo sapiens [sequence omitted]

SEQ ID NO: 894126 - protein, 171 aa, Homo sapiens
RSAEAAGTRFSSFPEAGPRPVRRRAGLARGQRRSAGVSSSGSEGAADAGRMYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFDVPLNP

SEQ ID NO: 894127 - protein, 223 aa, Homo sapiens
RSAEAAGTRFSSFPEAGPRPVRRRAGLARGQRRSAGVSSSGSEGAADAGRMYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTG

SEQ ID NO: 894128 - protein, 52 aa, Homo sapiens
MTDTENHDSAPSSTSTCCPPITAGMQLKDSLGPGSNRPLWTLRPLHLRVVCL

SEQ ID NO: 894129 - protein, 162 aa, Homo sapiens
MTHLIEYDRHRKSRLIPLQHLYLLPADHSRNAAERFPGAWFQPPTVDSEASAFAGGLPVIFWSWAGLVGFPFVWPVSMCLNPLSFIKSKTKENNNHILSSSLSLPLSLYTSNSLPFYPTISARLAQPIFTSARFINALRIRVHLAQFPLKGARLLHGPRFRV

SEQ ID NO: 894130 - protein, 105 aa, Homo sapiens
MTHLIEYDRHRKSRLIPLQHLYLLPADHSRNAAERFPGAWFQPPTVDSEASAFAGGLPVIFWSWAGLVGFPFVWPVSMCLNPLSFIKSKTKEKKNKNIWFYLALK

SEQ ID NO: 894131 - protein, 124 aa, Homo sapiens [sequence omitted]

SEQ ID NO: 894132 - protein, 133 aa, Homo sapiens
LTDHSKNKKLTSPGPPCQNRDNNSGDETGSSMTHLIEYDRHRKSRLIPLQHLYLLPADHSRNAAERFPGAWFQPPTVDSEASAFAGGLPVIFWSWAGLVGFPFVWPVSMCLNPLSFIKSKTKEKKPPWPLWPK

SEQ ID NO: 894133 - protein, 110 aa, Homo sapiens
MTHLIEYDRHRKSRLIPLQHLYLLPADHSRNAAERFPGAWFQPPTVDSEASAFAGGLPVIFWSWAGLVGFPFVWPVSMCLNPLSFIKSKTKEKGGAPKHTGLVGLKKKAL

SEQ ID NO: 894134 - protein, 52 aa, Homo sapiens; identical to SEQ ID NO: 894128

SEQ ID NO: 894135 - protein, 52 aa, Homo sapiens; identical to SEQ ID NO: 894128

SEQ ID NO: 894136 - protein, 349 aa, Homo sapiens
SGVWPQSRQWWLPIPKRRPPTPCAALLAGPVRKRVVELRTTPAGSRRQIPSPESCEKLSLVPDAAAARVPWQPQVSEPRATLPAPRLRARVDRSLSGCTLGIPDLDSAGEMPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 894137 - protein, 349 aa, Homo sapiens; identical to SEQ ID NO: 894136

SEQ ID NO: 894138 - protein, 331 aa, Homo sapiens
RSLAAVAAVVASHPQKAPSDSLRRTARRASPETGRGAPHHSRWFPKADPFSRELRETFPCPRRLPAPRLRARVDRSLSGCTLGIPDLDSAGEMPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 894139 - protein, 178 aa, Homo sapiens
MTTINRSLHEKTRSHHKAEASHKHRPRHDSRTESKKRGDKRKTRQQEEENRWERTQQYSERETKKGQNKHQKRNTATERKYQTPQQRGKPAGGKNRKERHNSTRGKKKKPKHQNPGESSNKERRQNKSTNRDTTRRELKDNTNNNDSHARDNNKHKARNTKRRRQKRGQTQKPQQRRQ

SEQ ID NO: 894140 - protein, 121 aa, Homo sapiens
MAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 894141 - protein, 114 aa, Homo sapiens
LNLAQGDMKFDWVMGLRSITLKNSSTGRGDGPKQHLQADPMLIIRARTLSLSVSLSVSPLGLTPHWTPLHPCPSHNTAAVSSACLWEMGSGGLDLGWGSGVEGEFICSLSILLY

SEQ ID NO: 894142 - protein, 65 aa, Homo sapiens
MQSCIESSELLYKELFDYVRILYSFPLNIKKKLKEAEGRVMHDARDPQCTWITMHVDHMRSSRSP

SEQ ID NO: 894143 - protein, 387 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894144 - protein, 447 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894145 - protein, 447 aa, Homo sapiens; identical to SEQ ID NO: 894144

SEQ ID NO: 894146 - protein, 447 aa, Homo sapiens; identical to SEQ ID NO: 894144

SEQ ID NO: 894147 - protein, 447 aa, Homo sapiens; identical to SEQ ID NO: 894144

SEQ ID NO: 894148 - protein, 447 aa, Homo sapiens; identical to SEQ ID NO: 894144

SEQ ID NO: 894149 - protein, 447 aa, Homo sapiens; identical to SEQ ID NO: 894144

SEQ ID NO: 894150 - protein, 447 aa, Homo sapiens; identical to SEQ ID NO: 894144

SEQ ID NO: 894151 - protein, 402 aa, Homo sapiens
MPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894152 - protein, 521 aa, Homo sapiens
PGRAGTFAPRGAYGGEGTRFWRLLGLGWGFLGGSPFARAAKSAGSCLCSAPAHWLATETSGQETAPSSSPSKGAPETAHPGSLVAWGFDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894153 - protein, 306 aa, Homo sapiens [sequence omitted]

SEQ ID NO: 894154 - protein, 544 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVLDTPGERRLRPDHQLGFLMSDSKRFAFSLLGEPWPMAPDPHSREARQQRFAHFTELAIVSVQEIVDFAKQLPGFLQLSREDQIALLKTSAIEVAGEGQGMKGEAEWDYLWEGPPDIELGEPNLLGSRDEENRPPWKRPCSKTSPPSPRLRFAACVQVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894155 - protein, 313 aa, Homo sapiens
MPHSAGGTAGVGLEAAEPTALLTRAEPPSEPTGVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894156 - protein, 286 aa, Homo sapiens
MALSLGVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894157 - protein, 387 aa, Homo sapiens; identical to SEQ ID NO: 894143

SEQ ID NO: 894158 - protein, 342 aa, Homo sapiens
ETIDWKVSMVFLRCLRFSGKLPFSGGYTFRGSAFWSRCITWSSVMLPYLVAFCMGPWGRASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894159 - protein, 272 aa, Homo sapiens
MAPDPHSREARQQRFAHFTELAIVSVQEIVDFAKQLPGFLQLSREDQIALLKTSAIEVAGEGQGMKGEAEWDYLWEGPPDIELGEPNLLGSRDEENRPPWKRPCSKTSPPSPRLRFAACVQVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894160 - protein, 175 aa, Homo sapiens
MIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 894161 - protein, 368 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSAG

SEQ ID NO: 894162 - protein, 409 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSAGVEEGQWETARDLHQGGLQVPQESVGGGGWWLGRVEAFAVLF

SEQ ID NO: 894163 - protein, 278 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILNALSCEGCKGFFRRSVIKGAHYIHHPHDRLMFPRMLMKLVSLRTLSSVHSEQVFALRLQDKKLPPLLSEIWDVHE

SEQ ID NO: 894164 - protein, 278 aa, Homo sapiens; identical to SEQ ID NO: 894163

SEQ ID NO: 894165 - protein, 258 aa, Homo sapiens
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPQVLTPNLAWYRKWHDRESSCQNSYGLLLTLGRWLKVHREPTVAFYRFVELLKRTVTMKSYSVARR

SEQ ID NO: 894166 - protein, 67 aa, Homo sapiens
ILLRDLLGCGEKAQSRWDCVQEGRGLAVAEEHKKDSRFNYLYILQDLNFASRVVMEEAKKQIETVPW

SEQ ID NO: 894167 - protein, 447 aa, Homo sapiens; identical to SEQ ID NO: 894144

SEQ ID NO: 894168 - protein, 215 aa, Homo sapiens
MPHSAGGTAGVGLEAAEPTALLTRAEPPSEPTGVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSAGVEEGQWETARDLHQGGLQVPQESVGGGGWWLGRVEAFAVLF

SEQ ID NO: 894169 - protein, 95 aa, Homo sapiens
PTRLCRARRGRANGCKDQASRGQRGVRATTVEARVRARTGRPTRRASDRLMFPRMLMKLVSLRTLSSVHSEQVFALRLQDKKLPPLLSEIWDVHE

SEQ ID NO: 894170 - protein, 136 aa, Homo sapiens
MQAARPREAAAASSERKPGCPTLLGVLQGWGWRLQSPQPCSPGQSPLQNPQRHQGSALHLPQWRPLPHGHLHASQVPGVSASQMPSGWHAGGVCPVRRTDPPEETEAAVHSEQVFALRLQDKKLPPLLSEIWDVHE

SEQ ID NO: 894171 - protein, 76 aa, Homo sapiens
RRKNPRAWPGAGHPCRRIGIPAHTVVFPAPQTPAGSSRAELRADKARSERPLTGARPLLRALAMMCGSSLLLLGNC

SEQ ID NO: 894172 - protein, 252 aa, Homo sapiens
RRKRAGRHKEEAGSRPCPRAWETLPRPGRARAPAAGGWSPLGHCEPGVSRSCRAAQAMDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 894173 - protein, 252 aa, Homo sapiens; identical to SEQ ID NO: 894172

SEQ ID NO: 894174 - protein, 241 aa, Homo sapiens
MCSGAGVMMARWAARGRAGWRSTVRILSPLGHCEPGVSRSCRAAQAMDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 894175 - protein, 174 aa, Homo sapiens
MSASQTYWCLASSKAVLTTASAESWTHWATSCQCWLPSGRATMSCRLMATAAANSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 894176 - protein, 114 aa, Homo sapiens
MSASQTYWCLASSKAVLTTASAESWNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 894177 - protein, 76 aa, Homo sapiens; identical to SEQ ID NO: 894171

SEQ ID NO: 894178 - protein, 84 aa, Homo sapiens
DCDPTTGETDDEGYEEIFQEQLAAVPEFRGLGPLFKSSPEPVALTESETEYVIRCTKHTFTNHMVFQFDCTNTLNDQTLENVTV

SEQ ID NO: 894179 - protein, 66 aa, Homo sapiens
CFLMTVLVWSTSVVNSMYSDAIGLYKVLPLSGASLWTQNTSVLQVETFVLASNRHASTCRITEQYC

SEQ ID NO: 894180 - protein, 252 aa, Homo sapiens; identical to SEQ ID NO: 894172

SEQ ID NO: 894181 - protein, 105 aa, Homo sapiens
RRKRAGRHKEEAGSRPCPRAWETLPRPGRARAPAAGGWSTTVPASGMSASQTYWCLASSKAVLTTASAESWTHWATSCQCWLPSGRATMSCRLMATAAATPAWEE

SEQ ID NO: 894182 - protein, 217 aa, Homo sapiens
PDCSRNSLGILNVSQRIIRNYPSGAGVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 894183 - protein, 159 aa, Homo sapiens
EGGSARGAIRRKRVVDRVRAPGRRCLGPDAPAPPRLEGDSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 894184 - protein, 163 aa, Homo sapiens
RRKRAGRHKEEAGSRPCPRAWETLPRPGRARAPAAGGWSPLGHCEPGVSRSCRAAQAMDCEVNNGSSLRDECITNLLVFGFLQSCSDNSFRRELDALGHELPVLAPQWEGYDELQTDGNRSSHSRLGRIEAASLLRDVFHTTVNFINQNLRTYVRSLARNGMD

SEQ ID NO: 894185 - protein, 252 aa, Homo sapiens; identical to SEQ ID NO: 894172

SEQ ID NO: 894186 - protein, 252 aa, Homo sapiens; identical to SEQ ID NO: 894172

SEQ ID NO: 894187 - protein, 412 aa, Homo sapiens
RVRVFLSKSPCPARLRALAPIAPAAARPEAARGARRPARPSSPAPPPPSRTAAASAASCTMSVAGLKKQFHKATQKVSEKVGGAEGTKLDDDFKEMERKVDVTSRAVMEIMTKTIEYLQPNPASRAKLSMINTMSKIRGQEKGPGYPQAEALLAEAMLKFGRELGDDCNFGPALGEVGEAMRELSEVKDSLDIEVKQNFIDPLQNLHDKDLREIQHHLKKLEGRRLDFDYKKKRQGKIPDEELRQALEKFDESKEIAESSMFNLLEMDIEQVSQLSALVQAQLEYHKQAVQILQQVTVRLEERIRQASSQPRREYQPKPRMSLEFPTGDSTQPNGGLSHTGTPKPSGVQMDQPCCRALYDFEPENEGELGFKEGDIITLTNQIDENWYEGMLHGHSGFFPINYVEILVALPH

SEQ ID NO: 894188 - protein, 412 aa, Homo sapiens; identical to SEQ ID NO: 894187

SEQ ID NO: 894189 - protein, 412 aa, Homo sapiens; identical to SEQ ID NO: 894187

SEQ ID NO: 894190 - protein, 412 aa, Homo sapiens; identical to SEQ ID NO: 894187

SEQ ID NO: 894191 - protein, 412 aa, Homo sapiens; identical to SEQ ID NO: 894187

SEQ ID NO: 894192 - protein, 163 aa, Homo sapiens
RVRVFLSKSPCPARLRALAPIAPAAARPEAARGARRPARPSSPAPPPPSRTAAASAASCTMSVAGLKKQFHKATQKVSEKVGGAEGTKLDDDFKEMERVSKWISPAAELCTTLNLKVSLHFSMQRGESFCFHTVPSQICESWNCQSKPSLTSKLSPDLNEFVS

SEQ ID NO: 894193 - protein, 412 aa, Homo sapiens; identical to SEQ ID NO: 894187

SEQ ID NO: 894194 - protein, 269 aa, Homo sapiens
MPLPLPSAFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPHKARCHDGGEEPPAHGHQGFAKRLQQGPVAWGRGVLLVHSQQWGWTHRWCLH

SEQ ID NO: 894195 - protein, 140 aa, Homo sapiens
MPLPLPSAFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDG

SEQ ID NO: 894196 - protein, 168 aa, Homo sapiens
MKAMGWGRGHKGWVPDDKGSEWRGMQSAAPALSATWLCRVVVTINKKRNLVVSVDDGGTFEVVLHRVWKGSSVHQDFLGFYVLDSHRMSARTHGLLGQFFHPIGFEVSDIHPGSDPHKARCHDGGEEPPAHGHQGFAKRLQQGPVAWGRGVLLVHSQQWGWTHRWCLH

SEQ ID NO: 894197 - protein, 102 aa, Homo sapiens
MPLPLPSAFVLSALQPSPTHSSSNTQRLPDRVTGGFSVNGQLIGNKARSPGQHDGTYFGRLGIANPATDFQLEVTPQNITLNPGFGGPVFSWRDQAVLRQDG

SEQ ID NO: 894198 - protein, 151 aa, Homo sapiens
CVSQRMKVDREVRANLSSQALRMSLDYGFVTPLTSMSIRGMADQDGLKPTIDKPSEDSPPLEMLGPRRTFVLSALQPSPTHSSSNTQRLPDRVTGGSDPHKARCHDGGEEPPAHGHQGFAKRLQQGPVAWGRGVLLVHSQQWGWTHRWCLH

SEQ ID NO: 894199 - protein, 330 aa, Homo sapiens
CVSQRMKVDREVRANLSSQALRMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPHKARCHDGGEEPPAHGHQGFAKRLQQGPVAWGRGVLLVHSQQWGWTHRWCLH

SEQ ID NO: 894200 - protein, 330 aa, Homo sapiens; identical to SEQ ID NO: 894199

SEQ ID NO: 894201 - protein, 259 aa, Homo sapiens
MPLPLPSAFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPHKARCHDGGEEPPAHGHQWFIHNNGAGLIDGAYTDYIVPDIF

SEQ ID NO: 894202 - protein, 350 aa, Homo sapiens
CVSQRMKVDREVRANLSSQALRMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPHKARCHDGGVCKKTTARTRGMGPRCPAGSFTTMGLDSSMVPTLIISSPTSSEPSGQHACPPPGPRQRRRTTS

SEQ ID NO: 894203 - protein, 287 aa, Homo sapiens
MAQVGAWRTGALGLALLLLLGLGLGLEAAASPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSAACHRTSPFVWYDPERSRTGYWCMMSPLVSDRDSSQTDFPPINIGTTDENMDD

SEQ ID NO: 894204 - protein, 277 aa, Homo sapiens [sequence omitted]

SEQ ID NO: 894205 - protein, 289 aa, Homo sapiens
GWSAGISGLESGLDSAWPAPLWGQHERRLDGAGWSVANRGSGPGAAAAARPRTRPGGRREPAFHPDLCPGRRPQLRLVPTHQRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 894206 - protein, 157 aa, Homo sapiens
MAQVGAWRTGALGLALLLLLGLGLGLEAAASPLSTPTSAQAAGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 894207 - protein, 277 aa, Homo sapiens [sequence omitted]

SEQ ID NO: 894208 - protein, 216 aa, Homo sapiens
MGFQGVTWAFLGGHLGPDQPCAPGIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 894209 - protein, 899 aa, Homo sapiens
VGGNGCSRRGSVRGAAVGCPAMDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHGPAVDWWALGVCLFEFLTGIPPFNDETPQQVFQNILKRDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 894210 - protein, 899 aa, Homo sapiens; identical to SEQ ID NO: 894209

SEQ ID NO: 894211 - protein, 827 aa, Homo sapiens
VGGNGCSRRGSVRGAAVGCPAMDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHELKRHPLFSDVDWENLQHQTMPFIPQPDDETDTSYFEARNTAQHLTVSGFSL

SEQ ID NO: 894212 - protein, 762 aa, Homo sapiens
VGGNGCSRRGSVRGAAVGCPAMDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRIGFLFVDLSVRNYSSMRLGLLKVPCQIRIMDHRRMQKKLSKSALNMGQVCMNISNELLAGKEFSSYKFR

SEQ ID NO: 894213 - protein, 350 aa, Homo sapiens
VGGNGCSRRGSVRGAAVGCPAMDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQV

SEQ ID NO: 894214 - protein, 247 aa, Homo sapiens
GGCRLCPCSGPHLAEGARARVGPMSRLRLSTAEWVDVTLQQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 894215 - protein, 176 aa, Homo sapiens
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQAGSPAINGRSQTDDEEMTGE

SEQ ID NO: 894216 - protein, 176 aa, Homo sapiens; identical to SEQ ID NO: 894215

SEQ ID NO: 894217 - protein, 176 aa, Homo sapiens; identical to SEQ ID NO: 894215

SEQ ID NO: 894218 - protein, 176 aa, Homo sapiens; identical to SEQ ID NO: 894215

SEQ ID NO: 894219 - protein, 176 aa, Homo sapiens; identical to SEQ ID NO: 894215

SEQ ID NO: 894220 - protein, 176 aa, Homo sapiens; identical to SEQ ID NO: 894215

SEQ ID NO: 894221 - protein, 203 aa, Homo sapiens
LVRARVNRRGGTASIGADVQAAEEEKEMDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQAGSPAINGRSQTDDEEMTGE

SEQ ID NO: 894222 - protein, 220 aa, Homo sapiens
MARYVAVMVNQTRVDRTRAPSRKREQGLPDCAVHCWMAAEEEKEMDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQAGSPAINGRSQTDDEEMTGE

SEQ ID NO: 894223 - protein, 243 aa, Homo sapiens
PALSCRDLTHASGSRVRPRHARSQDRCVVTFRRRGRHPGSASKAARCAGAAATDAGAEFGAAEEEKEMDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPIPPSTTTTIATSEQSTGSCDTSPDTVSPSLSPGFEDLSHVQAGSPAINGRSQTDDEEMTGE

SEQ ID NO: 894224 - protein, 176 aa, Homo sapiens; identical to SEQ ID NO: 894215

SEQ ID NO: 894225 - protein, 176 aa, Homo sapiens; identical to SEQ ID NO: 894215

SEQ ID NO: 894226 - protein, 176 aa, Homo sapiens; identical to SEQ ID NO: 894215

SEQ ID NO: 894227 - protein, 176 aa, Homo sapiens; identical to SEQ ID NO: 894215

SEQ ID NO: 894228 - protein, 176 aa, Homo sapiens; identical to SEQ ID NO: 894215

SEQ ID NO: 894229 - protein, 176 aa, Homo sapiens; identical to SEQ ID NO: 894215

SEQ ID NO: 894230 - protein, 176 aa, Homo sapiens; identical to SEQ ID NO: 894215

SEQ ID NO: 894231 - protein, 190 aa, Homo sapiens
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIPEASFLEEEDEDPSAMPGHAHSSWSRGAGHRGIFPELSLTSALKKLRRFPDTVSPSLSPGFEDLSHVQAGSPAINGRSQTDDEEMTGE

SEQ ID NO: 894232 - protein, 195 aa, Homo sapiens [sequence omitted]

SEQ ID NO: 894233 - protein, 176 aa, Homo sapiens; identical to SEQ ID NO: 894215

SEQ ID NO: 894234 - protein, 894 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 894235 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 894236 - protein, 110 aa, Homo sapiens
RRRAHGCFSFIVLTRASSAGESPAPPAPSSSSSSSSTSGFWGITVLSRQQVRLGLGGAGGPGRGPPVGRRARGSRGLRGRAAVTATQPAPGPGSGRSSPWGDAAWSGGRR

SEQ ID NO: 894237 - protein, 199 aa, Homo sapiens
PGLQRASPRLLQLLPPLPPPPPPPAFGGSLSSLGSRMSRQVVRSSKFRHVFGKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEGPDPTPRRAPPVLSVRRAGGLESCPPPSPSGGGGRPPK

SEQ ID NO: 894238 - protein, 264 aa, Homo sapiens
RLVRAGVNRPRESRLLQLLPPLPPPPPPPAFGGSLSSLGSRMSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRSLFFKAPQARPRVMGNS

SEQ ID NO: 894239 - protein, 461 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894240 - protein, 461 aa, Homo sapiens; identical to SEQ ID NO: 894239

SEQ ID NO: 894241 - protein, 461 aa, Homo sapiens; identical to SEQ ID NO: 894239

SEQ ID NO: 894242 - protein, 461 aa, Homo sapiens; identical to SEQ ID NO: 894239

SEQ ID NO: 894243 - protein, 454 aa, Homo sapiens [sequence omitted]

SEQ ID NO: 894244 - protein, 496 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARSLTPGPDRSMLLGQWAVPSPPNQTVGPASPSPSHRFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894245 - protein, 501 aa, Homo sapiens
SLGWYWSEILGSRLLQLLPPLPPPPPPPAFGGSLSSLGSRMSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894246 - protein, 429 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPPAGSAIHTHPLTSHSQPHGREKNHNKMALFSGTSQTLMTGPLDTQFAEPTSPRASPPPR

SEQ ID NO: 894247 - protein, 433 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQGGSLVPTAPGGGPDPALTAEEWLGGRDAGPLLISLKDGYVPPKSRELRVNRGLDTRAHGGHAMRRQVGTSPGS

SEQ ID NO: 894248 - protein, 371 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPCCRPKRRPGCPPGATFPVEAGRMA

SEQ ID NO: 894249 - protein, 461 aa, Homo sapiens; identical to SEQ ID NO: 894239

SEQ ID NO: 894250 - protein, 328 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTGRRRAAPEASGTPSSDAVSRLEEEMRKLQATVQELQKRLDRLEETVQAK

SEQ ID NO: 894251 - protein, 298 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTTVQELQKRLDRLEETVQAK

SEQ ID NO: 894252 - protein, 597 aa, Homo sapiens
MEAKRRGSGCRGESWARAPHGCHTGSPAEAAVPGRSHFQTSAPAWGQLGQAPWPLSFWEEPALQPHHSHSLSGELPPPPQPPYTCPGSRASCAHGSLTRGSWGGGANPKGRDRLRQRPAGTLPGSCTAPNLCHAWPALLGFAQAILGLEQEKNNPPPSPPQALVQLPGTPQLSSLGLSEGGVEEVGLGLGGKSTSKALLCLQTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894253 - protein, 492 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAVLREEGLGGGSWPAVDEGRRLMASDTVEERAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894254 - protein, 514 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAVSRHLPWPLTLQPLSFLSTISQALGCCPPSPPPGTGPVGYVRVPDLTTSLSLQEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894255 - protein, 345 aa, Homo sapiens
MLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894256 - protein, 341 aa, Homo sapiens
EDSQRHKEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894257 - protein, 523 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVSGGGDPGAGRGALGWDLTFGVLKTHWPLLCGVGDPGWGPDAAPAGARRHPGGPHQACGHCGLAHHSPERAAQCRCCGRRGLGVARGLQWMRAGGSWLLNCGERAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894258 - protein, 209 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYHCHDSASKVGPVPGGPVPTHRRARPCPHG

SEQ ID NO: 894259 - protein, 105 aa, Homo sapiens
MSRQVVRSSKFRHVFGQPAKADQCYEDVRVSQTTWDSGFCAVNPKFVALICEASGGGAFLVLPLGKVSPWGPGGSSSSTGPMALCRSCLGDGHQAFQGLCCHLEN

SEQ ID NO: 894260 - protein, 344 aa, Homo sapiens
MWPVLSQPFPHPFTPLPNPDGFKVILAIEFHMTLFSSVLDTFLKILLNIFLRMRNSYKCIFFVPLCLPFLAFQTPLSVTFVSFPPPFSLHSREWREKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 894261 - protein, 143 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVALGRPC

SEQ ID NO: 894262 - protein, 384 aa, Homo sapiens
QTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 894263 - protein, 384 aa, Homo sapiens; identical to SEQ ID NO: 894262

SEQ ID NO: 894264 - protein, 384 aa, Homo sapiens; identical to SEQ ID NO: 894262

SEQ ID NO: 894265 - protein, 653 aa, Homo sapiens
PGVRQPLLLLLLLLPPPPPPSLRPSVSAPGTRAPPQPASMSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 894266 - protein, 653 aa, Homo sapiens; identical to SEQ ID NO: 894265

SEQ ID NO: 894267 - protein, 653 aa, Homo sapiens; identical to SEQ ID NO: 894265

SEQ ID NO: 894268 - protein, 653 aa, Homo sapiens; identical to SEQ ID NO: 894265

SEQ ID NO: 894269 - protein, 653 aa, Homo sapiens; identical to SEQ ID NO: 894265

SEQ ID NO: 894270 - protein, 653 aa, Homo sapiens; identical to SEQ ID NO: 894265

SEQ ID NO: 894271 - protein, 631 aa, Homo sapiens
CKPQMIVLVTEWVDLSLVDRQCNGHIENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 894272 - protein, 630 aa, Homo sapiens
SQELFQTRLFFCRVSEQIELTPFCQENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 894273 - protein, 635 aa, Homo sapiens
PGVRQPLLLLLLLLPPPPPPSLRPSVSAPGTRAPPQPASMSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKRTRMRKLAREGENPPDGFMAPKAWKVLTDYYRSLEKN

SEQ ID NO: 894274 - protein, 331 aa, Homo sapiens [sequence omitted]

SEQ ID NO: 894275 - protein, 114 aa, Homo sapiens
MIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 894276 - protein, 550 aa, Homo sapiens
PGVRQPLLLLLLLLPPPPPPSLRPSVSAPGTRAPPQPASMSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVSNSQSWALRLRNSDSDFT

SEQ ID NO: 894277 - protein, 357 aa, Homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 894278 - protein, 357 aa, Homo sapiens; identical to SEQ ID NO: 894277

SEQ ID NO: 894279 - protein, 339 aa, Homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQVSDFFLPLHQRH

SEQ ID NO: 894280 - protein, 412 aa, Homo sapiens
CACVSFPKRAINSKNSAVSFPVSSLRLALRSSPAALLRAGSSTKFTANALALGSRMATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 894281 - protein, 357 aa, Homo sapiens; identical to SEQ ID NO: 894277

SEQ ID NO: 894282 - protein, 357 aa, Homo sapiens; identical to SEQ ID NO: 894277

SEQ ID NO: 894283 - protein, 357 aa, Homo sapiens; identical to SEQ ID NO: 894277

SEQ ID NO: 894284 - protein, 357 aa, Homo sapiens; identical to SEQ ID NO: 894277

SEQ ID NO: 894285 - protein, 343 aa, Homo sapiens [sequence omitted]

SEQ ID NO: 894286 - protein, 128 aa, Homo sapiens
MLWAGAHQHGRNWRKRETSPGTQGPLPPVPRARPALMATHAIAPTLSWAIPRQQCSPQPGRLNALPPDRCSGPHFGDRAPESCFPGACSVSGACAFKGTRPACPPQEPSLRSSRNRLREGQTFGRMEI

SEQ ID NO: 894287 - protein, 128 aa, Homo sapiens; identical to SEQ ID NO: 894286

SEQ ID NO: 894288 - protein, 482 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 894289 - protein, 329 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIK

SEQ ID NO: 894290 - protein, 225 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGESQPQ

SEQ ID NO: 894291 - protein, 111 aa, Homo sapiens
MHGVCKEGDNCRYSHDLSDSPYSVVCKYFQRGYCIYGDRCSRALRPMRRTWSSHLPCSAARTWCVGSAWRWSMRKPTPVSAASGSSPTATTPTVSSAFASGGVLSNLRARS

SEQ ID NO: 894292 - protein, 113 aa, Homo sapiens
VEVARALRYATRSRRGPNGCLSVLPLPSPGLAVLSPQPDRNYVIPEVPGPLLCGINSNGGGCNSRNNSHNIRSRSGSGDGGSSLPHPDPHSHRPVPGGGRRGRRQRRQRRRLD

SEQ ID NO: 894293 - protein, 329 aa, Homo sapiens; identical to SEQ ID NO: 894289

SEQ ID NO: 894294 - protein, 517 aa, Homo sapiens
VEVARALRYATRSRRGPNGCLSVLPLPSPGLAVLSPQPDRNYVIPEVPGPLLCGINSNGGGCNSRNNSHNIRSRSGSGDGGSSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 894295 - protein, 445 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIINNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 894296 - protein, 418 aa, Homo sapiens
MHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 894297 - protein, 418 aa, Homo sapiens; identical to SEQ ID NO: 894296

SEQ ID NO: 894298 - protein, 329 aa, Homo sapiens; identical to SEQ ID NO: 894289

SEQ ID NO: 894299 - protein, 315 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVESADTGRTVCISTEILVTCVGCRSCIQWMLPRDRSISNRALRPMRRTWSSHLPCSAARTWCVGSAWRWSMRKPTPVSAASGSSPTATTPTVSSAFASGGVLSNLRARS

SEQ ID NO: 894300 - protein, 329 aa, Homo sapiens; identical to SEQ ID NO: 894289

SEQ ID NO: 894301 - protein, 329 aa, Homo sapiens; identical to SEQ ID NO: 894289

SEQ ID NO: 894302 - protein, 329 aa, Homo sapiens; identical to SEQ ID NO: 894289

SEQ ID NO: 894303 - protein, 329 aa, Homo sapiens; identical to SEQ ID NO: 894289

SEQ ID NO: 894304 - protein, 412 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMRYEHCSLFSSEEPNRAWVHFEKNGAALYTPTSFLPFFDFPGQFILSP

SEQ ID NO: 894305 - protein, 422 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILDSRAWHSSRLCCPLRRPLRTFSPLPQPTRPTPPPPSAPAPGPARPPPIRPRSPPALPPPPLPP

SEQ ID NO: 894306 - protein, 351 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQFESKIIKSCPECRITSNALIPWIPPILSL

SEQ ID NO: 894307 - protein, 332 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQVLHPMDAAQRSQHIKSCIEAHEKDMELSFAVQRSKDMVCGICMEVVYEKANPSERRFGILSNCNHTYCLKCIRKWRSAKQRSLYFAAALL

SEQ ID NO: 894308 - protein, 189 aa, Homo sapiens
GRGLLPRRLRYLGQDATAAARDLRTRGLQGYCPSATARQQVLVSALQQLKGRRSEHRCVRSLGGGCSAAGGRTAPGTCGGKRKYLRWGRLHFRVGVSLAKLEPASQRCSAFPGLEQRPIVASRVHPSLTLRHGSPSPGGRWYFLARGPFWGAWGTGSLLPRPGWSLQTPKNFNRDTCWALARLSALRKH

SEQ ID NO: 894309 - protein, 265 aa, Homo sapiens
MGKCLRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 894310 - protein, 566 aa, Homo sapiens
GRGLLPRRLRYLGQDATAAARDLRTRGLQGYCPSATARQQVLVSALQQLKGRRSEHRCVRSLGGGCSAAGGRTAPGTCGGKRKYLRWGRLHFRVGVSLAKLEPASQRCSAFPGLEQRPIVASRVHPSLTLRHGSPSPGGRWYFLARGTLLGNENQEMPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 894311 - protein, 472 aa, Homo sapiens
GRGLLPRRLRYLGQDATAAARDLRTRGLQGYCPSATARQQVLVSALQQLKGRRSEHRNENQEMPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 894312 - protein, 451 aa, Homo sapiens
GRGLLPRRLRYLGQDATAAARDLRTRGLQGYCPSATARQQVLVSALQQLKGRRSEHRNENQEMPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQTEREKEEYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 894313 - protein, 265 aa, Homo sapiens; identical to SEQ ID NO: 894309

SEQ ID NO: 894314 - protein, 475 aa, Homo sapiens
GRGLLPRRLRYLGQDATAAARDLRTRGLQGYCPSATARQQVLVSALQQLKGRRSEHRCVRSLGGGCSAAGGRTAPGTCGGKRKYLRWGRLHFRVGVSLAKLEPASQRCSAFPGLEQRPIVASRVHPSLTLRHGSPSPGGRWYFLARGTLLGNENQEMPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVFKN

SEQ ID NO: 894315 - protein, 410 aa, Homo sapiens
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 894316 - protein, 265 aa, Homo sapiens; identical to SEQ ID NO: 894309

SEQ ID NO: 894317 - protein, 272 aa, Homo sapiens
CGAEAEAEERPAAAGSGGTGSGRRSRPEPSRAEPSRSGRRRPARRAATMSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 894318 - protein, 224 aa, Homo sapiens
MSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 894319 - protein, 272 aa, Homo sapiens; identical to SEQ ID NO: 894317

SEQ ID NO: 894320 - protein, 272 aa, Homo sapiens; identical to SEQ ID NO: 894317

SEQ ID NO: 894321 - protein, 272 aa, Homo sapiens; identical to SEQ ID NO: 894317

SEQ ID NO: 894322 - protein, 272 aa, Homo sapiens; identical to SEQ ID NO: 894317

SEQ ID NO: 894323 - protein, 272 aa, Homo sapiens; identical to SEQ ID NO: 894317

SEQ ID NO: 894324 - protein, 116 aa, Homo sapiens
FLSTLRIFKHRNLNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 894325 - protein, 299 aa, Homo sapiens
CGAEAEAEERPAAAGSGGTGSGRRSRPEPSRAEPSRSGRRRPARRAATMSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPVDPCNGVQRWLGPDRLWWPAQRAGVCVCGAGRMWCRQVPSLSTLTPKQ

SEQ ID NO: 894326 - protein, 274 aa, Homo sapiens
CGAEAEAEERPAAAGSGGTGSGRRSRPEPSRAEPSRSGRRRPARRAATMSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWATCHSR

SEQ ID NO: 894327 - protein, 299 aa, Homo sapiens; identical to SEQ ID NO: 894325

SEQ ID NO: 894328 - protein, 299 aa, Homo sapiens; identical to SEQ ID NO: 894325

SEQ ID NO: 894329 - protein, 252 aa, Homo sapiens
CGAEAEAEERPAAAGSGGTGSGRRSRPEPSRAEPSRSGRRRPARRAATMSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPG

SEQ ID NO: 894330 - protein, 261 aa, Homo sapiens
CGAEAEAEERPAAAGSGGTGSGRRSRPEPSRAEPSRSGRRRPARRAATMSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEGVCG

SEQ ID NO: 894331 - protein, 214 aa, Homo sapiens
CGAEAEAEERPAAAGSGGTGSGRRSRPEPSRAEPSRSGRRRPARRAATMSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISRDVGRRDEMLEGGMRCWKEP

SEQ ID NO: 894332 - protein, 132 aa, Homo sapiens
MPYKWNNTASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTEKLLSAT

SEQ ID NO: 894333 - protein, 212 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 894334 - protein, 189 aa, Homo sapiens
MPYKWNNTASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 894335 - protein, 199 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVLSATPGRSGLESGYQNLLRQHQPHGRPHLPAPDEDPRRSQPMRRQTLHLSCHRGAEQRNTGHHVRWPGPHPRPTLCRGQ

SEQ ID NO: 894336 - protein, 168 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSKKIPAYAETNPPSQLSPWS

SEQ ID NO: 894337 - protein, 212 aa, Homo sapiens; identical to SEQ ID NO: 894333

SEQ ID NO: 894338 - protein, 212 aa, Homo sapiens; identical to SEQ ID NO: 894333

SEQ ID NO: 894339 - protein, 155 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTEKLLSAT

SEQ ID NO: 894340 - protein, 202 aa, Homo sapiens
RLYRSESLDAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 894341 - protein, 170 aa, Homo sapiens
PRFPGCHGQRDFGKMAALTAEHFAALQSLLKLLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 894342 - protein, 212 aa, Homo sapiens; identical to SEQ ID NO: 894333

SEQ ID NO: 894343 - protein, 176 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQNPRRSQPMRRQTLHLSCHRGAEQRNTGHHVRWPGPHPRPTLCRGQ

SEQ ID NO: 894344 - protein, 187 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSIEKLLSAT

SEQ ID NO: 894345 - protein, 222 aa, Homo sapiens
PRFPGCHGQRDFGKMAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVATGEQKPPSLKSS

SEQ ID NO: 894346 - protein, 503 aa, Homo sapiens
CPTLSSGTSARFRGKNQFSGGLPQITLSPLAQPCGRLAAMYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894347 - protein, 447 aa, Homo sapiens
MYSNVIGTVTSGKSCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894348 - protein, 260 aa, Homo sapiens
MRPTRTSVSWYMEPSSSPWTSSEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894349 - protein, 445 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894350 - protein, 182 aa, Homo sapiens
MMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894351 - protein, 385 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPLCLRCIP

SEQ ID NO: 894352 - protein, 446 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGLIREVPLNTIIFMGRVANPCVK

SEQ ID NO: 894353 - protein, 235 aa, Homo sapiens
CPTLSSGTSARFRGKNQFSGGLPQITLSPLAQPCGRLAAMYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSSMSQMHSIRHFLR

SEQ ID NO: 894354 - protein, 464 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894355 - protein, 416 aa, Homo sapiens
MNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894356 - protein, 416 aa, Homo sapiens; identical to SEQ ID NO: 894355

SEQ ID NO: 894357 - protein, 344 aa, Homo sapiens
MTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894358 - protein, 397 aa, Homo sapiens
MNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894359 - protein, 356 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 894360 - protein, 280 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 894361 - protein, 265 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 894362 - protein, 146 aa, Homo sapiens
MPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 894363 - protein, 250 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVVF

SEQ ID NO: 894364 - protein, 204 aa, Homo sapiens
MPHEISLDDGAATIWTRLSYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 894365 - protein, 149 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMRWGFAMLARLVLNS

SEQ ID NO: 894366 - protein, 270 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYS

SEQ ID NO: 894367 - protein, 270 aa, Homo sapiens; identical to SEQ ID NO: 894366

SEQ ID NO: 894368 - protein, 290 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVIAQDDAEGSCLVEIVESSIRSYKRERSIVRPLSSVAVAFRDS

SEQ ID NO: 894369 - protein, 280 aa, Homo sapiens; identical to SEQ ID NO: 894360

SEQ ID NO: 894370 - protein, 280 aa, Homo sapiens; identical to SEQ ID NO: 894360

SEQ ID NO: 894371 - protein, 257 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQGRWLYALLACLEKPLLPEAHSLIRQLARRCSEVRLLVDSKDDERVPALNLLICLVSRYFDQRDLADEPS

SEQ ID NO: 894372 - protein, 270 aa, Homo sapiens; identical to SEQ ID NO: 894366

SEQ ID NO: 894373 - protein, 219 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMIGFPPLLSIVSRMNQGRWLYALLACLEKPLLPEAHSLIRQLARRCSEVRLLVDSKDDERVPALNLLICLVSRYFDQRDLADEPS

SEQ ID NO: 894374 - protein, 174 aa, Homo sapiens
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 894375 - protein, 128 aa, Homo sapiens
MATVAELKAVLKDTLEKKGVLGHLKARIRAEVFNALDDDREPRPSLSHENLLINELIREYLEFNKYKYTASVLIAAHCILRLLGSSSSPASASRVPGTTESGQPVVPLDRQFLIHELNAFEESKDNTI

SEQ ID NO: 894376 - protein, 104 aa, Homo sapiens
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTI

SEQ ID NO: 894377 - protein, 174 aa, Homo sapiens; identical to SEQ ID NO: 894374

SEQ ID NO: 894378 - protein, 198 aa, Homo sapiens
MATVAELKAVLKDTLEKKGVLGHLKARIRAEVFNALDDDREPRPSLSHENLLINELIREYLEFNKYKYTASVLIAAHCILRLLGSSSSPASASRVPGTTESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 894379 - protein, 174 aa, Homo sapiens; identical to SEQ ID NO: 894374

SEQ ID NO: 894380 - protein, 79 aa, Homo sapiens
ETRAGAQGRFEQSGPSQCKDNEDEDLYEDDFHINEYSILHPGTSFMIVREEEQDTMSCQCPSSMRGVHIQLQVLVAAHS

SEQ ID NO: 894381 - protein, 138 aa, Homo sapiens
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDET

SEQ ID NO: 894382 - protein, 73 aa, Homo sapiens
RRVLFFLFLGHGGTGTVECKGPGKATGEGKGEGKRGQPCAAASPEFGTSHSVSGALLGKAEITGTAGDRPSYS

SEQ ID NO: 894383 - protein, 141 aa, Homo sapiens
ARLRSSCEDAGRAGSGVRCGASWAGGRGSRARRVQTGGRARGADPQRPWSLQPSLGTAREGKSAPVAGLARGDSPSEASLAVWARGRPGRGKHGKVASRGCCGGRDGQPGDAWTWLVAKNIYRKIAYPLRWRGHRQASLRP

SEQ ID NO: 894384 - protein, 141 aa, Homo sapiens; identical to SEQ ID NO: 894383

SEQ ID NO: 894385 - protein, 104 aa, Homo sapiens
MCCGLCRMCVVSYVTCTEMHQACRSVCVHIADFWDTAGQERFQSMHASYYHKAHACIMVFDIQRKVTYRNLSTWYTELREFRPEIPCIVVANKIDGGAIPAPGC

SEQ ID NO: 894386 - protein, 141 aa, Homo sapiens; identical to SEQ ID NO: 894383

SEQ ID NO: 894387 - protein, 70 aa, Homo sapiens
ARLRSSCEDAGRAGSGVRCGASWAGGRGSRARRVQTGGRARGADPQRPWSRSPHLVIRPPRPPKVLGLQA

SEQ ID NO: 894388 - protein, 138 aa, Homo sapiens; identical to SEQ ID NO: 894381

SEQ ID NO: 894389 - protein, 104 aa, Homo sapiens; identical to SEQ ID NO: 894385

SEQ ID NO: 894390 - protein, 164 aa, Homo sapiens
MAEDKTKPSELDQGKYDADDNVKIICLGDSAVGKSKLMERFLMDGFQPQQLSTYALTLYKHTATVDGKTILVDINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 894391 - protein, 141 aa, Homo sapiens; identical to SEQ ID NO: 894383

SEQ ID NO: 894392 - protein, 141 aa, Homo sapiens; identical to SEQ ID NO: 894383

SEQ ID NO: 894393 - protein, 176 aa, Homo sapiens
MAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 894394 - protein, 261 aa, Homo sapiens
MTPAVPVGAGRVAPVHGCGHSIHGLQTHGAAACNPAPPDRAEMSGRIHLSTDRSEHCTQDPPSAWAKHPVASKLPWTLPLVNQGGMAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 894395 - protein, 170 aa, Homo sapiens [sequence omitted]

SEQ ID NO: 894396 - protein, 164 aa, Homo sapiens
MSYKGSDESYKGSDESKEEFSFTPNPTVFFLHPYGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 894397 - protein, 178 aa, Homo sapiens
MITKVVLPGQTLYLLPSRVADPCDFPKRGKETQLHNLWWQQMCLSFPLGEKKERGTLMVPTVPVRGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 894398 - protein, 176 aa, Homo sapiens; identical to SEQ ID NO: 894393

SEQ ID NO: 894399 - protein, 183 aa, Homo sapiens
MTPAVPVGAGRVAPVHGCGHSIHGLQTHGAAACNPAPPDRAEMSGRIHLSTDRSEHCTQDPPSAWAKHPVASKLPWTLPLVNQGGMAASTDMAGCPCQRLRPGSKGHVEQEILVPSLLDLPPRASCLVPLGWPTRPLTQAALRPLPPPLPAPTSVHLGTVCACSLMTPTQPQAWLTPDCLPHI

SEQ ID NO: 894400 - protein, 200 aa, Homo sapiens
MTPAVPVGAGRVAPVHGCGHSIHGLQTHGAAACNPAPPDRAEMSGRIHLSTDRSEHCTQDPPSAWAKHPVASKLPWTLPLVNQGGMAASTDMAGLEESFRKFAIHGDPKASGQEMNGKNWAKLCKDCKVADGKSVTGTDVDIVFSKVKGKSARVINYEEFKKALEELATKRFKGKSKEEAFVLFLLQLLSTWGQSVPVAS

SEQ ID NO: 894401 - protein, 147 aa, Homo sapiens
AEPPGAESHPGAGRERSCGAAWSPASIGPFLRRSVLPNAHFRSSREGGMAASTDMAGLEESFRKFAIHGDPKASGQEMNGKNWAKLCKDCKVADGKSVTGTDVDIVFSKVNPLPAPTSVHLGTVCACSLMTPTQPQAWLTPDCLPHI

SEQ ID NO: 894402 - protein, 190 aa, Homo sapiens
FHGKEEAFDAICQLVAGKEPANVGVTKAKTGGAVDRLTDTSRYTGSHKERFDESGKGKGIAGRQDILDDSGYVSAYKNAGTYDAKVKKGGMAASTDMAGLEESFRKFAIHGDPKASGQEMNGKNWAKLCKDCKVADGKSVTGTDVDIVFSKVKGKSARVINYEEFKKALEELATKRFKGKSKEEAFELPA

SEQ ID NO: 894403 - protein, 254 aa, Homo sapiens
AEPPERSPTREPAGSGAAEPPGLPRPSVHSCVVLSFRTHTSGAAARSEHCTQDPPSAWAKHPVASKLPWTLPLVNQGGMAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 894404 - protein, 266 aa, Homo sapiens
FHGKEEAFDAICQLVAGKEPANVGVTKAKTGGAVDRLTDTSRYTGSHKERFDESGKGKGIAGRQDILDDSGYVSAYKNAGTYDAKVKKGGMAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 894405 - protein, 178 aa, Homo sapiens; identical to SEQ ID NO: 894397

SEQ ID NO: 894406 - protein, 132 aa, Homo sapiens
MAASTDMAGLEESFRKFAIHGDPKASGQEMNGKNWAKLCKDCKVADGKSVTGTDVDIVFSKVKGKSARVINYEEFKKALEELATKRYTGSHKERFDESGKGKGIAGRQDILDDSGYVSAYKNAGTYDAKVKK

SEQ ID NO: 894407 - protein, 255 aa, Homo sapiens
MTPAVPVGAGRVAPVHGCGHSIHGLQTHGAAACNPAPPDRAEMSGRIHLSTDRSEHCTQDPPSAWAKHPVASKLPWTLPLVNQGGMAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDISSSCSNFCPPGDSLCL

SEQ ID NO: 894408 - protein, 580 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 894409 - protein, 98 aa, Homo sapiens
QAQQVQRPGGGKRCRYGWRGGRTSRALEVGSHFQAEPPGFSPQHPGGAGAEESELQAYIAQCQDSPTSGKFRRGSGSACSLLCCCGRDPSEEHSLLVN

SEQ ID NO: 894410 - protein, 732 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGEPLSPRPALTRGPGLSWDSPSPRSALPGGRDLPRNPLSLRSAQTRDPVLCWDPPSPRPALTGVLDSPQASPEPTDQPKPAVQPPRSPAWPGTNASLPRLHAILGPTRSALPAGDNSFRLLFDVVVILTCSLSFLLCARSLLRGFLLQNVRLLRHVCWCPPRLALGQIKARALRVLCLVRPSPRCLLQEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 894411 - protein, 855 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTGEWAGRGFTVGSLSCWDENQQLWLGTVAHAYNTSTLEAEEEGLLEARSLRPAWATEEDLVSTHKQISWAWWRAPVVPATQEAEAGGSLESGRLRLQEAMTTLLHSTLGDRVRPCLKKKKKKKKQVCLCECDSCHVESTRCYILIWLIQYNIRRPRECQACRNDPTLGKHREEGHWGLWGDQPGLPGPLRPFPDSLSLDCIQVDPPERPPPPPSDDLTLLESSSSYKNLTLKFHKYCLLTRGGPGWGRQHTRHSHPSNYFPKVGTGPPRPRWCLLGEHFPCQLQSQHVAGDAGTWGRKGPEDAPDPHPSLLPRLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 894412 - protein, 545 aa, Homo sapiens
MTPSQPTRGSSCTRPSSMLWTSTWRCLTCHWAGMRMSVVGVTLGPMAQGLLSASGTTTEATWTRPTTHLTLIRWWLLTASRWIPPSGPLRPPATISPSWKAAPVTRTSRSNSTSTACSLEGGPGWGRQHTRHSHPSNYFPKVGTGPPRPRWCLLGEHFPCQLQSQHVAGDAGTWGRKGPEDAPDPHPSLLPRLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 894413 - protein, 580 aa, Homo sapiens; identical to SEQ ID NO: 894408

SEQ ID NO: 894414 - protein, 221 aa, Homo sapiens
RIPGCACMWAHHEDGTEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 894415 - protein, 207 aa, Homo sapiens [sequence omitted]

SEQ ID NO: 894416 - protein, 658 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKYCLLTRGGPGWGRQHTRHSHPSNYFPKVGTGPPRPRWCLLGEHFPCQLQSQHVAGDAGTWGRKGPEDAPDPHPSLLPRLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 894417 - protein, 102 aa, Homo sapiens
MTAPAGPRGSETERLLTPNPGYGTQAGPSPAPPTPPEEEDLRRRLKYFFMSPCDKFRAKGRKPCKLMLQVVKILVVTVQVRPAKQGPQLKATCGCCAPGRES

SEQ ID NO: 894418 - protein, 556 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKPLHLHGAQPLHRAHHRRLRHHQASRRRRRRGERAAGLHRTVPGQPHLRQVPPRERLGLQPSLLLRKGPLGGAFAAGELIRPDCRWTVGPGLQRPPPPTPLIYL

SEQ ID NO: 894419 - protein, 580 aa, Homo sapiens; identical to SEQ ID NO: 894408

SEQ ID NO: 894420 - protein, 313 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTPLHLHGAQPLHRAHHRRLRHHQASRRRRRRGERAAGLHRTVPGQPHLRQVPPRERLGLQPSLLLRKGPLGGAFAAGELIRPDCRWTVGPGLQRPPPPTPLIYL

SEQ ID NO: 894421 - protein, 185 aa, Homo sapiens
PEEPEKGRRGWGDSHVAAGGFTTFSFAIDVIAKCVREAAAQPGREREGAGQVSSPGGFAAYGTAGRPRAPATRSGSAGSRPGPRSEGSREPWMVQAGPSSCSISGDPGLPRRWRPAQVVRPGRLRIRGWSRRIPKAEVGSPGDSQLLSLWRRGPVTEAPFSNPGAAFSPYRKSDGLMTSWLAAER

SEQ ID NO: 894422 - protein, 180 aa, Homo sapiens
PEGQQKGRRGWGDSHVAAGGFTTFSFAIDVIAKCVREAAAQPGREREGAGQVSSPGGFAAYGTAGRPRAPATRSGSAGSRPGPRSEGSREPWMVQAGPSSCSISGDPGLPRRWRPAQVVRPGRLRIRGWSRRIPKAEVGSPGDSQLLSLWRRGPVTEAPFSNPGAAFQRLNFSNHCFNSF

SEQ ID NO: 894423 - protein, 180 aa, Homo sapiens; identical to SEQ ID NO: 894422

SEQ ID NO: 894424 - protein, 185 aa, Homo sapiens; identical to SEQ ID NO: 894421

SEQ ID NO: 894425 - protein, 156 aa, Homo sapiens
PEEPEKGRRGWGDSHVAAGGFTTFSFAIDVIAKCVREAAAQPGREREGAGQVSSPGGFAAYGTAGRPRAPATRSGSAGSRPGPRSEGSREPWMVQAGPSSCSISGDPGLPRRWRPAQVVRPGRLRIRGWSRRIPKAEVGSPGDSQLLSLVFPLPEI

SEQ ID NO: 894426 - protein, 320 aa, Homo sapiens
MEKPSRWNKPPNHHLKVVDVDRLHPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 894427 - protein, 320 aa, Homo sapiens; identical to SEQ ID NO: 894426

SEQ ID NO: 894428 - protein, 320 aa, Homo sapiens; identical to SEQ ID NO: 894426

SEQ ID NO: 894429 - protein, 320 aa, Homo sapiens; identical to SEQ ID NO: 894426

SEQ ID NO: 894430 - protein, 320 aa, Homo sapiens; identical to SEQ ID NO: 894426

SEQ ID NO: 894431 - protein, 320 aa, Homo sapiens; identical to SEQ ID NO: 894426

SEQ ID NO: 894432 - protein, 320 aa, Homo sapiens; identical to SEQ ID NO: 894426

SEQ ID NO: 894433 - protein, 320 aa, Homo sapiens; identical to SEQ ID NO: 894426

SEQ ID NO: 894434 - protein, 320 aa, Homo sapiens; identical to SEQ ID NO: 894426

SEQ ID NO: 894435 - protein, 320 aa, Homo sapiens; identical to SEQ ID NO: 894426

SEQ ID NO: 894436 - protein, 320 aa, Homo sapiens; identical to SEQ ID NO: 894426

SEQ ID NO: 894437 - protein, 320 aa, Homo sapiens; identical to SEQ ID NO: 894426

SEQ ID NO: 894438 - protein, 320 aa, Homo sapiens; identical to SEQ ID NO: 894426

SEQ ID NO: 894439 - protein, 225 aa, Homo sapiens
MEKPSRWNKPPNHHLKVVDVDRLHPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGKILVKGL

SEQ ID NO: 894440 - protein, 320 aa, Homo sapiens; identical to SEQ ID NO: 894426

SEQ ID NO: 894441 - protein, 320 aa, Homo sapiens; identical to SEQ ID NO: 894426

SEQ ID NO: 894442 - protein, 296 aa, Homo sapiens
MEKPSRWNKPPNHHLKVVDVDRLHPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDKKEGFPLLWKGGTLLHVIPTAVQAAEHQEVVAVEEADLIEGEAEADTRNKQNFGPKSQFKETKSGNYSIITTQGLLKGKIVLLFLNSLLSSPP

SEQ ID NO: 894443 - protein, 320 aa, Homo sapiens; identical to SEQ ID NO: 894426

SEQ ID NO: 894444 - protein, 320 aa, Homo sapiens; identical to SEQ ID NO: 894426

SEQ ID NO: 894445 - protein, 219 aa, Homo sapiens
MEKPSRWNKPPNHHLKVVDVDRLHPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGW

SEQ ID NO: 894446 - protein, 320 aa, Homo sapiens; identical to SEQ ID NO: 894426

SEQ ID NO: 894447 - protein, 320 aa, Homo sapiens; identical to SEQ ID NO: 894426

SEQ ID NO: 894448 - protein, 320 aa, Homo sapiens; identical to SEQ ID NO: 894426

SEQ ID NO: 894449 - protein, 320 aa, Homo sapiens; identical to SEQ ID NO: 894426

SEQ ID NO: 894450 - protein, 427 aa, Homo sapiens
MEKPSRWNKPPNHHLKVVDVDRLHPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYAHAEWFQPTTEGPPAILMAETEPVHDSNYHETCLSRERGNIVVAMDEKLASLRARARVVSYYCSDGLGGIRWSDTTQDEEGAPLHTNGGGKLPPPVRGLTSQQPHTTAEPATKGGLDGPRTDSHQLGRGTGEGKQQATTHANNGMDQTPPEQQNKEGIETEQTNARHTRTEHGTSRKSRPAPPKVGPDGSTYRLPDTAATQTAVTRSAVQ

SEQ ID NO: 894451 - protein, 314 aa, Homo sapiens
QLMSEVVSEDPSGEQSLPPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 894452 - protein, 320 aa, Homo sapiens; identical to SEQ ID NO: 894426

SEQ ID NO: 894453 - protein, 320 aa, Homo sapiens; identical to SEQ ID NO: 894426

SEQ ID NO: 894454 - protein, 315 aa, Homo sapiens
ANSARGLQEVLEGLYFLEVAPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 894455 - protein, 263 aa, Homo sapiens
MDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 894456 - protein, 267 aa, Homo sapiens
MFKKMIFFLKLLYHVEEIVMEVHLEGNRCPLVEMFICPQEMMGILLKTAIQAEITQVLVILEIMHHHHEIILTVIMVIPVHVMTIHQEDIAIEMDMVVIVTIQIIQVEVPTEIHMRVMVTHVVLHLHEGPRHLMVEAVAMMITAAHVTDMVEVETVTQAAEVISTQVVVIGLADKKEGFPLLWKGGTLLHVIPTAVQAAEHQEVVAVEEADLIEGEAEADTRNKQNFGPKSQFKETKSGNYSIITTQGLLKGKIVLLFLNSLLSSPP

SEQ ID NO: 894457 - protein, 237 aa, Homo sapiens
VATTAWAPQEMMGILLKTAIQAEITQVLVILEIMHHHHEIILTVIMVIPVHVMTIHQEDIAIEMDMVVIVTIQIIQVEVPTEIHMRVMVTHVVLHLHEGPRHLMVEAVAMMITAAHVTDMVEVETVTQAAEVISTQVVVIGLADKKEGFPLLWKGGTLLHVIPTAVQAAEHQEVVAVEEADLIEGEAEADTRNKQNFGPKSQFKETKSGNYSIITTQGLLKGKIVLLFLNSLLSSPP

SEQ ID NO: 894458 - protein, 126 aa, Homo sapiens
MEKPSRWNKPPNHHLKVVDVDRLHPPPPPRSRGPPRGLRGGRGGSGGTRGPPSRGGHMDDGGYSMNFNMSSSRGPLPVKRGPPPRSGGPPPKRSAPSGPVRSSSGMGGRGKCSMYDDLCYYRNTKN

SEQ ID NO: 894459 - protein, 807 aa, Homo sapiens
LQAQLKELQRENDLLRKELDIKDSKLGSSMNSIKTFWSPELKKERVLRKEEAARMSVLKEQMRVSHEENQHLQLTIQALQDELRTQRDLNHLLQQESGNRGAEHFTIELTEENFRRLQAEHDRQAKELFLLRKTLEEMELRIETQKQTLNARDESIKKLLEMLQSKGLPSKSLEDDNERTRRMAEAESQVSHLEVILDQKEKENIHLREELHRRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKAHNIEDDSRMNPEFADQIKQLDKEASYYRDECGKAQAEVDRLLEILKEVENEKNDKDKKIAELESFLRHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKKKTQEEVMALKREKDRLVHQLKQQTQNRMKLMADNYDDDHHHYHHHHHHHHHRSPGRSQHSNHRPSPDQDDEEGIWA

SEQ ID NO: 894460 - protein, 130 aa, Homo sapiens
MLFSGTRTTEHSLAGLGGNSWRRILEMKQEALLAAISEKDANIALLELSASKKKKTQEEVMALKREKDRLVHQLKQQTQNRMKLMADNYDDDHHHYHHHHHHHHHRSPGRSQHSNHRPSPDQDDEEGIWA

SEQ ID NO: 894461 - protein, 807 aa, Homo sapiens; identical to SEQ ID NO: 894459

SEQ ID NO: 894462 - protein, 807 aa, Homo sapiens; identical to SEQ ID NO: 894459

SEQ ID NO: 894463 - protein, 371 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894464 - protein, 264 aa, Homo sapiens
ARYVAGGPVRPAVPGRLPAPFLTWKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894465 - protein, 385 aa, Homo sapiens
RSRFSSSSRSRSGQKLVSTSGFFPSFLFFVVISSLSISSSYMAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894466 - protein, 413 aa, Homo sapiens
MTGLRQEGAEPVFLLGGTAGTGLSSPRLGTQRPGSGPSALRARPLPPRPSEPGLCPGPMDTGQGGSSPPGEAGRPEPDLASPLARRLLPEPLAPVEAGTTLPGASGSPTASENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894467 - protein, 264 aa, Homo sapiens; identical to SEQ ID NO: 894464

SEQ ID NO: 894468 - protein, 251 aa, Homo sapiens
MCDGATCTSLRKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894469 - protein, 183 aa, Homo sapiens
MYEEEMEREEITTKKSEEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894470 - protein, 420 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHVSPFSPSTRSGCSTLGFGSGWWGQCAQAGGVGRGRDGPSRRRFPALGSQHHSFYDFIVTKARGKSGPLFNFDVHDDVRLLSDATVEKDESHAGKVVLRSWYEKNKHIFPASRWEPYDPEKKWDKYTIR

SEQ ID NO: 894471 - protein, 504 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSECLRSQTRGAWAQASFPVHSLLGGALSPKAALSGAGDQEAALPCRVRRSRSPSATGMALGTGGQSRRQRAACFLLTMGPASLRFRGKELTFLTWEAPGILRITGSRAWPPVWGVSPGLAEALQRRLDRLGLCLVESPSAASAFPSQLLDSRIQMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894472 - protein, 371 aa, Homo sapiens; identical to SEQ ID NO: 894463

SEQ ID NO: 894473 - protein, 241 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGEEIEITFSYWDGSGHRRTVKMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894474 - protein, 339 aa, Homo sapiens
MCDGATCTSLRKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKVGSVQPGFLLTMGPASLRFRGKELTFLTWEAPGILRITGSRAWPPVWGVSPGLAEALQRRLDRLGLCLVESPSAASAFPSQLLDSRIQMRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894475 - protein, 123 aa, Homo sapiens
MRKGNTMQQFLQKALEILRKDFSELRSAGVEQLMYIKEDLIIPHHHSFYDFIVTKARGKSGPLFNFDVHDDVRLLSDATVEKDESHAGKVVLRSWYEKNKHIFPASRWEPYDPEKKWDKYTIR

SEQ ID NO: 894476 - protein, 313 aa, Homo sapiens
ARYVAGGPVRPAVPGRLPAPFLTWKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHVSPFSPSTRSGCSTLGFGSGWWGQCAQAGGVGRGRDGPSRRRFPALGSQHHSFYDFIVTKARGKSGPLFNFDVHDDVRLLSDATVEKDESHAGKVVLRSWYEKNKHIFPASRWEPYDPEKKWDKYTIR

SEQ ID NO: 894477 - protein, 371 aa, Homo sapiens
MAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKEDLIIPHHHSFYDFIVTKARGKSGECRRPSRPHSTLPPMLSLGQQRDIGLHFSPAGPLFNFDVHDDVRLLSDATVEKDESHAGKVVLRSWYEKNKHIFPASRWEPYDPEKKWDKYTIR

SEQ ID NO: 894478 - protein, 371 aa, Homo sapiens; identical to SEQ ID NO: 894463

SEQ ID NO: 894479 - protein, 280 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELSMQRRIG

SEQ ID NO: 894480 - protein, 215 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDLSKPGLACSGLRPCTGRALPAP

SEQ ID NO: 894481 - protein, 245 aa, Homo sapiens
MAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEIHIVGSAAHEVPTTLMPVNTVALKVPANPASVSTVPSKLPTSSKPPGAVPSNALTNPAPSKLPINSTRAGMVPSKVPTSMVLTKVSASTVPTSWAAG

SEQ ID NO: 894482 - protein, 229 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKELPLVPCNQAKASDVQDLLKDLKAQSQVLGWILIAVVIIILLIFTSVTRCLSPVSFLQLKFWKIYLEQEQQILKSKATEHATDWQRDIKL

SEQ ID NO: 894483 - protein, 181 aa, Homo sapiens
QLTVRPPPPLPLPLSLSPPPPPAAAAAAAAAAMAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKCAWVRTQAHFSCCSLPSSWNFRRVPPCPINFCIFSRDRVSPC

SEQ ID NO: 894484 - protein, 156 aa, Homo sapiens
MAQYKGAASEAGRAMHLMKKREKQREQMEQMKQRIAEENIMKSNIDKKFSAHYDAVEAELKSSTVDYVANRGLVATRGLVATRGLVANRGLVANRGLVANRGLVANRGLVANRGLVANRGLVANRGLVANRGLVANRGLVANRGLVANLTSSQPWT

SEQ ID NO: 894485 - protein, 599 aa, Homo sapiens
MHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQWEICKPKYLNKTSVRPGLKNCGDVNCIGRIHTYLELIGAINFGCEQAVYNRPQTVDKVRIRDRKDAVEAYQLAQRLQSMRTRRRRVRDPWGNWCDAKDLEGQTFEHLSAEELAKRREEEKGRPVKSLKVPRPTKSSFDPFQLIPCNFFSEEKQEPFQVKVASEALLIMDLHAHVSMAEVIGLLGGRYSEVDKVVEVCAAEPCNSLSTGLQCEMDPVSQTQASETLAVRGFSVIGWYHSHPAFDPNPSLRDIDTQAKYQSYFSRGGAKFIGMIVSPYNRNNPLPYSQITCLVISEEISPDGSYRLPYKFEVQQMLEEPQWGLVFEKTRWIIEKYRLSHSSVPMDKIFRRDSDLTCLQKLLECMRKTLSKVTNCFMAEEFLTEIENLFLSNYKSNQENGVTEENCTKEVVNVIILKLRHFNLDTVDLTFKVINLK

SEQ ID NO: 894486 - protein, 575 aa, Homo sapiens
MHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQWEICKPKYLNKTSVRPGLKNCGDVNCIGRIHTYLELIGAINFGCEQAVYNRPQTVDKVRIRDRKDAVEAYQLAQRLQSMRTRRRRVRDPWGNWCDAKDLEGQTFEHLSAEELAKRREEEKGRPVKSLKVPRPTKSSFDPFQLIPCNFFSEEKQEPFQVKVASEALLIMDLHAHVSMAEVIGLLGGRYSEVDKVVEVCAAEPCNSLSTGLQCEMDPVSQTQASETLAVRGFSVIGWYHSHPAFDPNPSLRDIDTQAKYQSYFSRGGAKFIGMIVSPYNRNNPLPYSQITCLVISEEISPDGSYRLPYKFEVQQMLEEPQWGLVFEKTRWIIEKYRLSHSSVPMDKIFRRDSDLTCLQKLLECMRKTLSKVTNCFMAEEFLTEIENLFLSNYKSNQENGVTEENCTKELLM

SEQ ID NO: 894487 - protein, 575 aa, Homo sapiens; identical to SEQ ID NO: 894486

SEQ ID NO: 894488 - protein, 167 aa, Homo sapiens
MHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQW

SEQ ID NO: 894489 - protein, 575 aa, Homo sapiens; identical to SEQ ID NO: 894486

SEQ ID NO: 894490 - protein, 244 aa, Homo sapiens
MHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQWEICKPKYLNKTSVRPGLKNCGDVNCIGRIHTYLELIGAINFGCGKNKNPTTSFTRHFLSLQHLFISMMVRIQVVIGI

SEQ ID NO: 894491 - protein, 698 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEKEVVMFIILQGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894492 - protein, 688 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894493 - protein, 688 aa, Homo sapiens; identical to SEQ ID NO: 894492

SEQ ID NO: 894494 - protein, 688 aa, Homo sapiens; identical to SEQ ID NO: 894492

SEQ ID NO: 894495 - protein, 645 aa, Homo sapiens
ETPSQNNNNNIRNRLAVGVSIDAVFANTIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894496 - protein, 645 aa, Homo sapiens
ARYPSPHWLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894497 - protein, 497 aa, Homo sapiens
TSQWSIWDAGLISCHHNHILSQHISTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894498 - protein, 365 aa, Homo sapiens [sequence omitted]

SEQ ID NO: 894499 - protein, 381 aa, Homo sapiens
SRVSQIPFHPQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894500 - protein, 354 aa, Homo sapiens
PHDSSLEEVAVLTIALLPSSVAVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894501 - protein, 363 aa, Homo sapiens
STSVQTSRLAKSKMLTPEHVFIHPGWKLGEVPEGRTNFDDDIALVRLKDPVKMGPTVYPICLEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894502 - protein, 307 aa, Homo sapiens
MIPFSDRSYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894503 - protein, 314 aa, Homo sapiens
QLVETQCSESCRKIGFIIIWGEGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894504 - protein, 275 aa, Homo sapiens
MGPGLPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 894505 - protein, 598 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRISLLT

SEQ ID NO: 894506 - protein, 688 aa, Homo sapiens; identical to SEQ ID NO: 894492

SEQ ID NO: 894507 - protein, 688 aa, Homo sapiens; identical to SEQ ID NO: 894492

SEQ ID NO: 894508 - protein, 688 aa, Homo sapiens; identical to SEQ ID NO: 894492

SEQ ID NO: 894509 - protein, 688 aa, Homo sapiens; identical to SEQ ID NO: 894492

SEQ ID NO: 894510 - protein, 688 aa, Homo sapiens; identical to SEQ ID NO: 894492

SEQ ID NO: 894511 - protein, 688 aa, Homo sapiens; identical to SEQ ID NO: 894492

SEQ ID NO: 894512 - protein, 628 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSW

SEQ ID NO: 894513 - protein, 596 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRNKR

SEQ ID NO: 894514 - protein, 514 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVECHTDPTKDHRYTCRLISPETGTVWASSSVGVDSKWC

SEQ ID NO: 894515 - protein, 206 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPVWRGSSRTA

SEQ ID NO: 894516 - protein, 684 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQDQGW

SEQ ID NO: 894517 - protein, 640 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSSKGGDQCITFCSL

SEQ ID NO: 894518 - protein, 601 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRILSPEYLL

SEQ ID NO: 894519 - protein, 465 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGPSTPNRRVNSSILSDSSGFWVNCA

SEQ ID NO: 894520 - protein, 139 aa, Homo sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTVTR

SEQ ID NO: 894521 - protein, 216 aa, Homo sapiens
MGPRNPSPDHLSESESEEEENISYLNESSGEEWDSSEEEDSMVPNLSPLESLAWQVKCLLKYSTTWKPLNPNSWLYHAKLLDPSTPVHILREIGLRLSHCSHCVPKLEPIPEWPPLASCGVPPFQKPLTSPSRLSRDHATLNGALQFATKQLSRTLSRATPIPEYLKQIPNSCVSGCCCGWLTKTVKETTRTEPINTTYSYTDFQKAVNKLLTASL

SEQ ID NO: 894522 - protein, 216 aa, Homo sapiens; identical to SEQ ID NO: 894521

SEQ ID NO: 894523 - protein, 245 aa, Homo sapiens
IRTLALMGPPGLPGQIGPPGAPGIPGQKGEIGLPGPPGHDGKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 894524 - protein, 133 aa, Homo sapiens
EGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 894525 - protein, 127 aa, Homo sapiens
GCSPAGCVRSKLEEEGLGDYGRHREPIRGSRRRRVAGAGPERRQGQPERRQELGGRGAGAVGVGWTCGIDVCAVQEPPRGESGDSGGGCALRPGQGFPSLPSSSLLPSTWARSQDLTAGSAQEDRVP

SEQ ID NO: 894526 - protein, 577 aa, Homo sapiens
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 894527 - protein, 577 aa, Homo sapiens; identical to SEQ ID NO: 894526

SEQ ID NO: 894528 - protein, 577 aa, Homo sapiens; identical to SEQ ID NO: 894526

SEQ ID NO: 894529 - protein, 577 aa, Homo sapiens; identical to SEQ ID NO: 894526

SEQ ID NO: 894530 - protein, 514 aa, Homo sapiens
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGIQYL

SEQ ID NO: 894531 - protein, 514 aa, Homo sapiens; identical to SEQ ID NO: 894530

SEQ ID NO: 894532 - protein, 424 aa, Homo sapiens
MPLLSNHEIVQIAIFPPTVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 894533 - protein, 347 aa, Homo sapiens
MKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 894534 - protein, 277 aa, Homo sapiens [sequence omitted]

SEQ ID NO: 894535 - protein, 114 aa, Homo sapiens
VRRLEKEDARPRPRRRSRLGDRLVPGQSWEAVFREPPGLGCGGREAAPSCALGRGRAALLSSYSDPQVSGPHTVWLSEIKTSTIAMLIGQRMCCGHKTKLWRTEDSFQGSACIQ

SEQ ID NO: 894536 - protein, 114 aa, Homo sapiens; identical to SEQ ID NO: 894535

SEQ ID NO: 894537 - protein, 186 aa, Homo sapiens
GKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPARGQPLPTPPAPPDPFKSPASKGPLASTDLVTDWTCGLSVLGPTDGGDM

SEQ ID NO: 894538 - protein, 66 aa, Homo sapiens
MYYFLCHLALVDAGFTTSVVPPLLANLRGPALWLPRSHCTAQLCASLALGSAECVLLAVMALDRAA

SEQ ID NO: 894539 - protein, 264 aa, Homo sapiens
MLQKPRNRGRSGGQAERDRDWSHSGNPGASRAGEDARVLRDGFAEEAPSTSRGPGGSQGSQGPSPQGARRAQAAPAVGPRSQKQLELKVSELVQFLLIKDQKKIPIKRADILKHVIGDYKDIFPDLFKRAAERLQYVFGYKLVELEPKSNTYILINTLEPVEEDAEMRGDQGTPTTGLLMIVLGLIFMKGNTIKETEAWDFLRRLGVYPTKKHLIFGDPKKLITEDFVRQRLPGIPADTPHRPRRLRIPVGPANQPGNQQDESS

SEQ ID NO: 894540 - protein, 264 aa, Homo sapiens; identical to SEQ ID NO: 894539

SEQ ID NO: 894541 - protein, 264 aa, Homo sapiens; identical to SEQ ID NO: 894539

SEQ ID NO: 894542 - protein, 264 aa, Homo sapiens; identical to SEQ ID NO: 894539

SEQ ID NO: 894543 - protein, 4206 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGDIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIMQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNGNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKSASDADEGSNADITYAIEADSESVKENLEINKLSGVITTKESLIGLENEFFTFFVRAVDNGSPSKESVVLVYVKILPPEMQLPKFSEPFYTFTVSEDVPVGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVQGYFYWWWCLFSAVR

SEQ ID NO: 894544 - protein, 162 aa, Homo sapiens
EGGGRAFHPRHSCGRPERPQRPGPPQPPRPLLPLSGWRAQPENPVRARGGGRGGALTSPPLPHRLQGGGSGERGSESPQPAAATPQLGGWLPGHVLTNLAAPGPSFRPRALSFRLRLVLKFALVGSLRRCGRLGPGGTDVGTLVRDMLKIPGRQSWYFKPGS

SEQ ID NO: 894545 - protein, 4206 aa, Homo sapiens; identical to SEQ ID NO: 894543

SEQ ID NO: 894546 - protein, 3749 aa, Homo sapiens
MQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNGNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKSASDADEGSNADITYAIEADSESVKENLEINKLSGVITTKESLIGLENEFFTFFVRAVDNGSPSKESVVLVYVKILPPEMQLPKFSEPFYTFTVSEDVPVGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 894547 - protein, 4130 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGDIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIMQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNGNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKSASDADEGSNADITYAIEADSESVKENLEINKLSGVITTKESLIGLENEFFTFFVRAVDNGSPSKESVVLVYVKILPPEMQLPKFSEPFYTFTVSEDVPVGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGESSSRRD

SEQ ID NO: 894548 - protein, 4176 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGDIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIMQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNGNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKSASDADEGSNADITYAIEADSESVKENLEINKLSGVITTKESLIGLENEFFTFFVRAVDNGSPSKESVVLVYVKILPPEMQLPKFSEPFYTFTVSEDVPVGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNHKSGGS

SEQ ID NO: 894549 - protein, 1450 aa, Homo sapiens
MGWYRIRKCAGTDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 894550 - protein, 1093 aa, Homo sapiens
LEESNDTVQRKEKDHNLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 894551 - protein, 565 aa, Homo sapiens
MTLSQKIKILKGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 894552 - protein, 4206 aa, Homo sapiens; identical to SEQ ID NO: 894543

SEQ ID NO: 894553 - protein, 261 aa, Homo sapiens
SQWARYTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 894554 - protein, 135 aa, Homo sapiens
RIPGRRYLIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 894555 - protein, 4206 aa, Homo sapiens; identical to SEQ ID NO: 894543

SEQ ID NO: 894556 - protein, 4169 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGDIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIMQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNGNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKSASDADEGSNADITYAIEADSESVKENLEINKLSGVITTKESLIGLENEFFTFFVRAVDNGSPSKESVVLVYVKILPPEMQLPKFSEPFYTFTVSEDVPVGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSNPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGQLLLHSDG

SEQ ID NO: 894557 - protein, 2352 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGDIDWDSHPFGYNLTLQAKDKGTPPQFSSVKVIHVTSPQFKAGPVKFEKDVYRAEISEFAPPNTPVVMVKAIPAYSHLRYVFKRTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDLFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIMQVEATDKDLGPNGHVTYSILTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDAGRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYRVIATDKDEGPNAEISYSIEDGNEHGKFFIEPKTGVVSSKRFSAAGEYDILSIKAVDNGRPQKSSTTRLHIEWISKPKQSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVSPAHLTVMVRDQDVPVKRNFARIVVNVSDTNDHAPWFTASSYKGRVYESAAVGSVVLQVTALDKDKGKNAEVLYSIESGNIGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGSPINEPLFYHILNPDRRFKISRTSGVLSTTGTPFDREQQEAFDVVVEVIEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLK

SEQ ID NO: 894558 - protein, 110 aa, Homo sapiens
NKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDSKSHFFISLKCHLR

SEQ ID NO: 894559 - protein, 383 aa, Homo sapiens [sequence omitted]

SEQ ID NO: 894560 - protein, 351 aa, Homo sapiens [sequence omitted]

SEQ ID NO: 894561 - protein, 541 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894562 - protein, 178 aa, Homo sapiens
SDAAGRSRGSPRAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894563 - protein, 140 aa, Homo sapiens
PRVADAWVDPPRRGRVGEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894564 - protein, 541 aa, Homo sapiens; identical to SEQ ID NO: 894561

SEQ ID NO: 894565 - protein, 541 aa, Homo sapiens; identical to SEQ ID NO: 894561

SEQ ID NO: 894566 - protein, 541 aa, Homo sapiens; identical to SEQ ID NO: 894561

SEQ ID NO: 894567 - protein, 541 aa, Homo sapiens; identical to SEQ ID NO: 894561

SEQ ID NO: 894568 - protein, 541 aa, Homo sapiens; identical to SEQ ID NO: 894561

SEQ ID NO: 894569 - protein, 478 aa, Homo sapiens
MTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894570 - protein, 541 aa, Homo sapiens; identical to SEQ ID NO: 894561

SEQ ID NO: 894571 - protein, 668 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYACLALSLGRAPSGQVPISLFPWACLPSLLFLPMCWLGCARGVSLAIISLMGSWFDLSHGMTGADAAQILPPECPCVAGVDPGCRVGRSDLVGLVRPLETPGRSSTFLQPVSTSLVLRDTSGRQPARYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894572 - protein, 516 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRSSAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894573 - protein, 559 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLNQFPRLWCLEIPEGGSQPWYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894574 - protein, 440 aa, Homo sapiens
NRLVRGRVLNRPRLVCGASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894575 - protein, 420 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894576 - protein, 384 aa, Homo sapiens
NRLVRGRVLNRPRLVCGIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894577 - protein, 297 aa, Homo sapiens
MSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894578 - protein, 241 aa, Homo sapiens
NRLVRGRVLNRPRLVCGCGLDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894579 - protein, 178 aa, Homo sapiens; identical to SEQ ID NO: 894562

SEQ ID NO: 894580 - protein, 412 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISSETQT

SEQ ID NO: 894581 - protein, 550 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKAAVLGELFQEPPCHPFFPFLTLKPTIKGARSG

SEQ ID NO: 894582 - protein, 175 aa, Homo sapiens
GLTLEDPHAAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894583 - protein, 524 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKGQGGGQVGLNGPLQLWLPAESLTFLPQPLRFYIFYFSVYLYKNLLNINIPRDQKPRPRAQGSCAG

SEQ ID NO: 894584 - protein, 176 aa, Homo sapiens
MIRFELVPHAAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGGQGGGQVGLNGPLQLWLPAESLTFLPQPLRFYIFYFSVYLYKNLLNINIPRDKKPRPRAQGSCAG

SEQ ID NO: 894585 - protein, 400 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAGSCAG

SEQ ID NO: 894586 - protein, 483 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEFSDSEEEGEGGRKGTLPTSKKPRESKQRMKKRKTQRRRKKSPKEEKTKEEKPEAKGVRKELPV

SEQ ID NO: 894587 - protein, 438 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRISICSSDKRIACEEEQTPEMPSACLVALERCPY

SEQ ID NO: 894588 - protein, 408 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVAMRTKTTLTRRIST

SEQ ID NO: 894589 - protein, 403 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPARFKCRRFLRTPSLRRVADLLFFSGS

SEQ ID NO: 894590 - protein, 104 aa, Homo sapiens
ELGAPAPSSHLGSCGSHCLHFCPEALGWVISCQSLLSPQGQGGGQVGLNGPLQLWLPAESLTFLPQPLRFYIFYFSVYLYKNLLNINIPRDKKPRPRAQGSCAG

SEQ ID NO: 894591 - protein, 133 aa, Homo sapiens
MKKRKTQRRRKVGLGSAGTWVSRPERMNLCRAVGGGSDSGPASSCGALPQFLEPFSGSQKWQSPQNNEPLLPEHGSHIPPQPFSQHCTPVSQGAASAHQVLAVAGWETSPTCSQQGSLGGPGMGFSLFMSSEL

SEQ ID NO: 894592 - protein, 1393 aa, Homo sapiens
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDKDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 894593 - protein, 1315 aa, Homo sapiens [sequence omitted]

SEQ ID NO: 894594 - protein, 1393 aa, Homo sapiens; identical to SEQ ID NO: 894592

SEQ ID NO: 894595 - protein, 725 aa, Homo sapiens
MLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 894596 - protein, 1375 aa, Homo sapiens
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDKDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQLPNSTLPEGFELYSQLPPLRQHYLQRLTSTVLQNGVSET

SEQ ID NO: 894597 - protein, 173 aa, Homo sapiens
QLGWYEPGESAEALPIHRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 894598 - protein, 122 aa, Homo sapiens
RRSRGPITQLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 894599 - protein, 772 aa, Homo sapiens
MKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 894600 - protein, 1340 aa, Homo sapiens
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDKDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSSVSYISIFRGRKGASN

SEQ ID NO: 894601 - protein, 1330 aa, Homo sapiens
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDKDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSGIRDLG

SEQ ID NO: 894602 - protein, 106 aa, Homo sapiens
MIWFHVIVIHTPYVCIYIPTLPLSTSFPLSQLPVSLECYTVPPEDNLALLQLYFRTLVTGALRPRWCPVLYAVAVAHVNSFIFSQDPQSSSVSYISIFRGRKGASN

SEQ ID NO: 894603 - protein, 207 aa, Homo sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 894604 - protein, 207 aa, Homo sapiens; identical to SEQ ID NO: 894603

SEQ ID NO: 894605 - protein, 170 aa, Homo sapiens
NFFSFPSPLLEFFKFKGFGSLSNLPRSFTLRRSSASISRQSHLEPDTFEATQDDMVTVPKSPPAYARSSDMYSHMGTMPRPSIKKAQNSQAARQAQEAGPKPNLVPGGVPDPPGLEAAKEVMVKATGPLEDTPAMEPNPSAVEVDPIRKPEVPTGDVEEERPPRDVHSER

SEQ ID NO: 894606 - protein, 703 aa, Homo sapiens
MTAVGRRCPALGSRGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 894607 - protein, 860 aa, Homo sapiens
MTEGTKKTSKKFKFFKFKGFGSLSNLPRSFTLRRSSASISRQSHLEPDTFEATQDDMVTVPKSPPAYARSSDMYSHMGTMPRPSIKKAQNSQAARQAQEAGPKPNLVPGGVPDPPGLEAAKEVMVKATGPLEDTPAMEPNPSAVEVDPIRKPEVPTGDVEEERPPRDVHSERAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 894608 - protein, 482 aa, Homo sapiens
MTAVGRRCPALGSRGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLER

SEQ ID NO: 894609 - protein, 703 aa, Homo sapiens; identical to SEQ ID NO: 894606

SEQ ID NO: 894610 - protein, 692 aa, Homo sapiens [sequence omitted]

SEQ ID NO: 894611 - protein, 326 aa, Homo sapiens
HVTMWTAWLLGYGRYQGDADPNGSPLGHGTAHPPPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 894612 - protein, 65 aa, Homo sapiens
MSIMLAVDILGCTGSAEERAALLHKTIQLAAELRGTMGNMFSFAAVMGALDMAQVLRAAQSWHPV

SEQ ID NO: 894613 - protein, 410 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQVGLGISTLLMYVPTPLAATHQSGSLALLTGALWLMNELRRVPK

SEQ ID NO: 894614 - protein, 388 aa, Homo sapiens [sequence omitted]

SEQ ID NO: 894615 - protein, 410 aa, Homo sapiens; identical to SEQ ID NO: 894613

SEQ ID NO: 894616 - protein, 410 aa, Homo sapiens; identical to SEQ ID NO: 894613

SEQ ID NO: 894617 - protein, 410 aa, Homo sapiens; identical to SEQ ID NO: 894613

SEQ ID NO: 894618 - protein, 410 aa, Homo sapiens; identical to SEQ ID NO: 894613

SEQ ID NO: 894619 - protein, 312 aa, Homo sapiens
MVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQVGLGISTLLMYVPTPLAATHQSGSLALLTGALWLMNELRRVPK

SEQ ID NO: 894620 - protein, 253 aa, Homo sapiens
MQRLLFPPLRALKGRQYLPLLAPRAAPRAQCDCIRRPLRPGQYSTISEVALQSGRGTVSLPSKAAERVVGRWPLVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQVGLGISTLLMYVPTPLAATHQSGSLALLTGALWLMNELRRVPK

SEQ ID NO: 894621 - protein, 368 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQV

SEQ ID NO: 894622 - protein, 311 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLMLGKVILPNHTLENVQKKFLVHTSLVS

SEQ ID NO: 894623 - protein, 189 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTGIKFVVLADPRQAGIDSLLRKIYEIYSDFALKNPFYSLEMPIRCELQTR

SEQ ID NO: 894624 - protein, 343 aa, Homo sapiens
GSLSRGAETRQPAFAMKRPKEPSGSDGESDGPIDVGQEGQLSQMARPLSTPSSSQMQARKKRRGIIEKRRRDRINSSLSELRRLVPTAFEKQGSSKLEKAEVLQMTVDHLKMLHATGGTGFFDARALAVDFRSIGFRECLTEVIRYLGVLEGPSSRADPVRIRLLSHLNSYAAEMEPSPTPTGPLAFPAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 894625 - protein, 135 aa, Homo sapiens
GSLSRGAETRQPAFAMKRPKEPSGSDGESDGPIDVGQEGQLSQMARPLSTPSSSQMQARKKRRGIIEKRRRDRINSSLSELRRLVPTAFEKQGSSKLEKAEVLQMTVDHLKMLHATGGTGTHALLFQASFIQQIF

SEQ ID NO: 894626 - protein, 204 aa, Homo sapiens
GSLSRGAETRQPAFAMKRPKEPSGSDGESDGPIDVGQEGQLSQMARPLSTPSSSQMQSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 894627 - protein, 343 aa, Homo sapiens; identical to SEQ ID NO: 894624

SEQ ID NO: 894628 - protein, 121 aa, Homo sapiens
GSLSRGAETRQPAFAMKRPKEPSGSDGESDGPIDVGQEGQLSQMARPLSTPSSSQMQARKKRRGIIEKRRRDRINSSLSELRRLVPTAFEKQGSSKLEKAEVLQMTVDHLKMLHATGGTDR

SEQ ID NO: 894629 - protein, 262 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKTKNLSIPQSSIHTAYDCVMR

SEQ ID NO: 894630 - protein, 194 aa, Homo sapiens [sequence omitted]

SEQ ID NO: 894631 - protein, 254 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKKQKGGAPKRTP

SEQ ID NO: 894632 - protein, 194 aa, Homo sapiens [sequence omitted]

SEQ ID NO: 894633 - protein, 278 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYNRKTKTKKSKKDSRQKKAENRGGAKKNPEGGQKGPPHF

SEQ ID NO: 894634 - protein, 247 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKNTHN

SEQ ID NO: 894635 - protein, 375 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKTINFKKNFGENYSGGRKTRDKMGTGQKGLPRTQILVHQGGHITGNTTTSGGPQKIGEETRGTRRREKKGMRHPKYQNSTMQTEEDPTEQINKNRQREQQKTSKQRPIKSATDKKKLKTNEAHEETNGREEETD

SEQ ID NO: 894636 - protein, 293 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKKKEETKTKKHKQNKGGAKKTRGAHYRRTHFFTVPTTPASNTRGRKREWKL

SEQ ID NO: 894637 - protein, 194 aa, Homo sapiens [sequence omitted]

SEQ ID NO: 894638 - protein, 258 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKNKQKQKHTHTKPRQKKT

SEQ ID NO: 894639 - protein, 253 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKKKEETKTKKT

SEQ ID NO: 894640 - protein, 298 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKQQQETKNKKNKKKKAGGLFGGGKKGLKGGGLLVFANPSFERGKGGPTRGGDIKRD

SEQ ID NO: 894641 - protein, 252 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKQQQETKNKK

SEQ ID NO: 894642 - protein, 247 aa, Homo sapiens; identical to SEQ ID NO: 894634

SEQ ID NO: 894643 - protein, 254 aa, Homo sapiens; identical to SEQ ID NO: 894631

SEQ ID NO: 894644 - protein, 262 aa, Homo sapiens; identical to SEQ ID NO: 894629

SEQ ID NO: 894645 - protein, 243 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYNAK

SEQ ID NO: 894646 - protein, 243 aa, Homo sapiens; identical to SEQ ID NO: 894645

SEQ ID NO: 894647 - protein, 278 aa, Homo sapiens; identical to SEQ ID NO: 894633

SEQ ID NO: 894648 - protein, 323 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKKKKKKKKKKGGPPQKFPPGGPKFRRSPVFCVQKGAPLWGGFNTPRGTAGPASLKTRVARTGGQNGWTEPGGNALVGKGTL

SEQ ID NO: 894649 - protein, 287 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKKKKKKKNCVWGGEKSHLKIKGVPWMGGEEKGGGGPGSRFGLLGLV

SEQ ID NO: 894650 - protein, 250 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKKGPGLGLGAGDDRRQEGFKSTLSLPGGCWDCPRFSPGPKLNQGIRRFYKKITARRLPS

SEQ ID NO: 894651 - protein, 175 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQPSEVMGVNSPRGYRFTLAHSSPGSWGSLLPQ

SEQ ID NO: 894652 - protein, 175 aa, Homo sapiens; identical to SEQ ID NO: 894651

SEQ ID NO: 894653 - protein, 151 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQVPPRMGT

SEQ ID NO: 894654 - protein, 203 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNANIAPAPPWPFVD

SEQ ID NO: 894655 - protein, 207 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSFVLPWDSQKHIDFSLAHASPYGGFGRPGRVKRKNAKSAADPELLRYILKSC

SEQ ID NO: 894656 - protein, 175 aa, Homo sapiens; identical to SEQ ID NO: 894651

SEQ ID NO: 894657 - protein, 182 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSPREEEECQEGARVGAWGWRRQKAGGI

SEQ ID NO: 894658 - protein, 175 aa, Homo sapiens; identical to SEQ ID NO: 894651

SEQ ID NO: 894659 - protein, 175 aa, Homo sapiens; identical to SEQ ID NO: 894651

SEQ ID NO: 894660 - protein, 164 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALQDPGLSKLGLAKVQSKPRSRALIPPAPYQGPQAGGEHPRPSRRQKAGGI

SEQ ID NO: 894661 - protein, 145 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDEAGLHPGGLKIRGFLRRDALLLGKGPEVFLFPKKRGWAWPKSNPNHARVL

SEQ ID NO: 894662 - protein, 175 aa, Homo sapiens; identical to SEQ ID NO: 894651

SEQ ID NO: 894663 - protein, 124 aa, Homo sapiens
MPVARSWVCRKTYVTPRRPFEKSRLDQELKLIGEYGLRNKREVWRVKFTLAKIRKGQPGKLLTLDEKDPRRSVRRQTPCCGGLVRIFGVLDEGKDLSSPGIPRSTSTSLLRMPLLTGGLAARAA

SEQ ID NO: 894664 - protein, 116 aa, Homo sapiens
MPVARSWVCRKTYVTPRRPFEKSRLDQELKLIGEYGLRNKREVWRVKFTLAKIRKGQPGKLLTLDEKDPRRSVRRVRKQVVNIPVLHLSSPGIPRSTSTSLLRMPLLTGGLAARAA

SEQ ID NO: 894665 - protein, 116 aa, Homo sapiens; identical to SEQ ID NO: 894664

SEQ ID NO: 894666 - protein, 117 aa, Homo sapiens
MPVARSWVCRKTYVTPRRPFEKSRLDQELKLIGEYGLRNKREVWRVKFTLAKIRKGQPGKLLTLDEKDPRRSVRRCVWESTAEGWGAGLVRFILPSVASVPVMRVVSLDKWSQPSNF

SEQ ID NO: 894667 - protein, 194 aa, Homo sapiens [sequence omitted]

SEQ ID NO: 894668 - protein, 194 aa, Homo sapiens [sequence omitted]

SEQ ID NO: 894669 - protein, 194 aa, Homo sapiens [sequence omitted]

SEQ ID NO: 894670 - protein, 110 aa, Homo sapiens
MAMFGYMTDTGTVEPLQTVEVETQGDDLQSLLFHFLDEWLYKFSADEFFIPRRQGVAMLSRLVLNSWLPAILLPQFCKVLGLQVGRRIFIVQAPSGNRSQSNNIFSNAGL

SEQ ID NO: 894671 - protein, 167 aa, Homo sapiens
MAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 894672 - protein, 110 aa, Homo sapiens
MAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 894673 - protein, 146 aa, Homo sapiens
GNSRCRLLLLNSRPRRGVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPRVGRRIFIVQAPSGNRSQSNNIFSNAGL

SEQ ID NO: 894674 - protein, 136 aa, Homo sapiens
MAQEEEDVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPRVGRRIFIVQAPSGNRSQSNNIFSNAGL

SEQ ID NO: 894675 - protein, 110 aa, Homo sapiens; identical to SEQ ID NO: 894672

SEQ ID NO: 894676 - protein, 110 aa, Homo sapiens; identical to SEQ ID NO: 894672

SEQ ID NO: 894677 - protein, 163 aa, Homo sapiens
MQSVRDYNLTEEQKAIKAKYPPVNRKYEYLDHTADVQLHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 894678 - protein, 110 aa, Homo sapiens; identical to SEQ ID NO: 894670

SEQ ID NO: 894679 - protein, 167 aa, Homo sapiens; identical to SEQ ID NO: 894671

SEQ ID NO: 894680 - protein, 136 aa, Homo sapiens; identical to SEQ ID NO: 894674

SEQ ID NO: 894681 - protein, 131 aa, Homo sapiens
MFQSWLHAWGDTLEEAFEQCAMAMFGYMTDTGTVEPLQTVEVETQGDDLQSLLFHFLDEWLYKFSADEFFIPREVKVLSIDQRNFKLRSIGWGEEFSLSKHPQGTEVKAITYSAMQVYNEENPEVFVIIDI

SEQ ID NO: 894682 - protein, 156 aa, Homo sapiens
MAMFGYMTDTGTVEPLQTVEVETQGDDLQSLLFHFLDEWLYKFSADEFFIPRKLCAIVFRKGCKGQARWLTPVIPALWEAEAGGSPEVQEFETSLTNKEVKVLSIDQRNFKLRSIGWGEEFSLSKHPQGTEVKAITYSAMQVYNEENPEVFVIIDI

SEQ ID NO: 894683 - protein, 110 aa, Homo sapiens; identical to SEQ ID NO: 894670

SEQ ID NO: 894684 - protein, 95 aa, Homo sapiens
MAQEEEDVRDYNLTEEQKAIKAKYPPVNRKYEYPRSCCIVQAEVQWHHHSSLHPLLSDPKAQVILPPEPPELRLQACATTPTKFLKFFVETATFY

SEQ ID NO: 894685 - protein, 1951 aa, Homo sapiens
IPRSLSGNEGAELSLRGGGLVWIKETKKPGEVSKNKTVRVPFRRLQAQGGGAKVQQPCEPSWSRSADSRLGARSPRSAESRAPSRPLQGPLDSEKLAAGRGRENSPRASSVPTTKLFAVPARTTLQPPRAMRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 894686 - protein, 1951 aa, Homo sapiens; identical to SEQ ID NO: 894685

SEQ ID NO: 894687 - protein, 1951 aa, Homo sapiens; identical to SEQ ID NO: 894685

SEQ ID NO: 894688 - protein, 163 aa, Homo sapiens
MTHTFFFKSTAFCSSIFPQEFYDPLCPHPHSSTGAPFVQKGEGPSIRESLDTALSLLLSPDFLLPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 894689 - protein, 104 aa, Homo sapiens
RGTGVYRCVQVVTTGTEHAGNLCIFSRDGVSPCKPGWFRSPDLVIRPPRPPKLRGLQAGAIALRSSQISNVVFPLHSETPALSLQKTMAGIPLSLQAETHSNPN

SEQ ID NO: 894690 - protein, 484 aa, Homo sapiens
IPRSLSGNEGAELSLRGGGLVWIKETKKPGEVSKNKTVRVPFRRLQAQGGGAKVQQPCEPSWSRSADSRLGARSPRSAESRAPSRPLQGPLDSEKLAAGRGRENSPRASSVPTTKLFAVPARTTLQPPRAMRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGKDTLSWVLEEQGL

SEQ ID NO: 894691 - protein, 688 aa, Homo sapiens
MSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894692 - protein, 242 aa, Homo sapiens
RECVSSLPQCWPFRPESGGRKERNIRKKIKQKIELLMSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVRLLTAAPRP

SEQ ID NO: 894693 - protein, 741 aa, Homo sapiens
GGGAGAVLVSSRPAERVEAAAQLVSAPASPSRSPPPRFRRVGMSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894694 - protein, 741 aa, Homo sapiens; identical to SEQ ID NO: 894693

SEQ ID NO: 894695 - protein, 741 aa, Homo sapiens; identical to SEQ ID NO: 894693

SEQ ID NO: 894696 - protein, 741 aa, Homo sapiens; identical to SEQ ID NO: 894693

SEQ ID NO: 894697 - protein, 688 aa, Homo sapiens; identical to SEQ ID NO: 894691

SEQ ID NO: 894698 - protein, 699 aa, Homo sapiens
MTAASSDILTHQLNCSQIAGPQKLPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894699 - protein, 688 aa, Homo sapiens; identical to SEQ ID NO: 894691

SEQ ID NO: 894700 - protein, 588 aa, Homo sapiens
MQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894701 - protein, 688 aa, Homo sapiens; identical to SEQ ID NO: 894691

SEQ ID NO: 894702 - protein, 703 aa, Homo sapiens
PLMCVFSSPVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894703 - protein, 588 aa, Homo sapiens; identical to SEQ ID NO: 894700

SEQ ID NO: 894704 - protein, 688 aa, Homo sapiens; identical to SEQ ID NO: 894691

SEQ ID NO: 894705 - protein, 688 aa, Homo sapiens; identical to SEQ ID NO: 894691

SEQ ID NO: 894706 - protein, 691 aa, Homo sapiens
MSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGTPIRSPLTTSYNSAQHYTETSLGMNSPLLTCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894707 - protein, 452 aa, Homo sapiens
MLLVVILSWCFKKKNTDLWSFLNIIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 894708 - protein, 76 aa, Homo sapiens
SQTFLLRGPETRLCSGELRHITKLKPWSLFDVLVEKYGWPHEDAAQFTDFLIPMLEMVPEKRASAGECLRHPWLNS

SEQ ID NO: 894709 - protein, 259 aa, Homo sapiens
GGGAGAVLVSSRPAERVEAAAQLVSAPASPSRSPPPRFRRVGMSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVRLLTAAPRP

SEQ ID NO: 894710 - protein, 106 aa, Homo sapiens
MSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGKAR

SEQ ID NO: 894711 - protein, 249 aa, Homo sapiens
GGGAGAVLVSSRPAERVEAAAQLVSAPASPSRSPPPRFRRVGMSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQ

SEQ ID NO: 894712 - protein, 568 aa, Homo sapiens
GGGAGAVLVSSRPAERVEAAAQLVSAPASPSRSPPPRFRRVGMSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKGKCFFPSTVCHR

SEQ ID NO: 894713 - protein, 271 aa, Homo sapiens
GGGAGAVLVSSRPAERVEAAAQLVSAPASPSRSPPPRFRRVGMSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQPSRVRLLTHEYGSTAETYRKNI

SEQ ID NO: 894714 - protein, 892 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894715 - protein, 65 aa, Homo sapiens
MSIVDPNRLGVVTFQAFIDFMSRETADTDTADQVMASFKILAGDKNYITMDEQHHEFAEQHHEFA

SEQ ID NO: 894716 - protein, 149 aa, Homo sapiens
PERGEVAPLAGRSPWGSVVQATLRLLQPSPRGLCSGAVVFRLGLRPRLGAACSGSIFPFLPPLATSPYGVRWQRRFLGRPGFNLSGGPPGTLLPLRRRGERRRDRRPPPDLPGEGPAGVRLGTRKLGGVRGLPRGPCGGGVRTADRFIA

SEQ ID NO: 894717 - protein, 892 aa, Homo sapiens; identical to SEQ ID NO: 894714

SEQ ID NO: 894718 - protein, 892 aa, Homo sapiens; identical to SEQ ID NO: 894714

SEQ ID NO: 894719 - protein, 892 aa, Homo sapiens; identical to SEQ ID NO: 894714

SEQ ID NO: 894720 - protein, 892 aa, Homo sapiens; identical to SEQ ID NO: 894714

SEQ ID NO: 894721 - protein, 892 aa, Homo sapiens; identical to SEQ ID NO: 894714

SEQ ID NO: 894722 - protein, 831 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894723 - protein, 770 aa, Homo sapiens
MCMSQYPACNFSAGTRALVVKTSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894724 - protein, 831 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894725 - protein, 882 aa, Homo sapiens
MDSVADCLGRSLIMGETHREHRRASGGQALRDATMISPTLHSERHAGNSTSNAGIRTVKHGARDRQARQEISMRCARMLHTYDTVGHCSLALHSLLVALCPLTCSNVQSAHEENVLAQGKVDWLPAAPVEEYTDTFLFYHIHMCSTTNSHANSPYDTSWEGSGPCGNVLVRLIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894726 - protein, 887 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894727 - protein, 654 aa, Homo sapiens
MTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894728 - protein, 865 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894729 - protein, 914 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQATTLPWTSCAASCHPTRLSTASRGWPPTPAPTPCQVLWTTCPSPRRCTARVTSNPPRPAALVLCAVPCLAPPPSPISCLGSVSAPSLHPGELGPTWHRSSLPAK

SEQ ID NO: 894730 - protein, 637 aa, Homo sapiens
FIHLSAMVLNDNHRRIDVCYGKLREAEQVNLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894731 - protein, 609 aa, Homo sapiens
MGLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894732 - protein, 477 aa, Homo sapiens
MLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894733 - protein, 858 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKGALDYMSFSTALYGESDL

SEQ ID NO: 894734 - protein, 930 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMGEAEFARIMSIVDPNRLGVVTFQAFIDFMSRETADTDTADQVMASFKILAGDKLQEGGKMQTAHAAFTPPGFAAVSGRAALRLLDFAAFLTTLSSQNYITMDELRRELPPDQAEYCIARMAPYTGPDSVPGALDYMSFSTALYGESDL

SEQ ID NO: 894735 - protein, 892 aa, Homo sapiens; identical to SEQ ID NO: 894714

SEQ ID NO: 894736 - protein, 892 aa, Homo sapiens; identical to SEQ ID NO: 894714

SEQ ID NO: 894737 - protein, 880 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYLVKRHIGACVFASSLVHENIL

SEQ ID NO: 894738 - protein, 846 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQCPRSDSLQNYFLQKRKKSYVKNQKTTYFIIEKVFFLHQTNGKKEERLTICTEMSCFVAT

SEQ ID NO: 894739 - protein, 892 aa, Homo sapiens; identical to SEQ ID NO: 894714

SEQ ID NO: 894740 - protein, 503 aa, Homo sapiens
LVREWTLGDVIIVQLIELLCDGGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894741 - protein, 720 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDGALDYMSFSTALYGESDL

SEQ ID NO: 894742 - protein, 457 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894743 - protein, 365 aa, Homo sapiens
FDGSTTMLREDDTNGEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894744 - protein, 823 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASVLWTTCPSPRRCTARVTSNPPRPAALVLCAVPCLAPPPSPISCLGSVSAPSLHPGELGPTWHRSSLPAK

SEQ ID NO: 894745 - protein, 660 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPVLWTTCPSPRRCTARVTSNPPRPAALVLCAVPCLAPPPSPISCLGSVSAPSLHPGELGPTWHRSSLPAK

SEQ ID NO: 894746 - protein, 784 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMVT

SEQ ID NO: 894747 - protein, 780 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRVRAPSCAFLVQPPTPAPGPW

SEQ ID NO: 894748 - protein, 257 aa, Homo sapiens
ILPISSILVWIQAKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894749 - protein, 259 aa, Homo sapiens
CVASHCAAVGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894750 - protein, 738 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDTFQQTRQQPNLQPIGQQSRFGLGETKPCFQPNPIRP

SEQ ID NO: 894751 - protein, 719 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHLSHLRQYEKSIVNYKPKIDQLEGDHQLIQEALIFDNKHTNYTMEHIRVGWEQLLTTIARTINEVENQILTRDAKGISQEQMNEFRASFNHFDRVRAPSCAFLVQPPTPAPGPW

SEQ ID NO: 894752 - protein, 462 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELK

SEQ ID NO: 894753 - protein, 187 aa, Homo sapiens
MGSARWHIRVGWEQLLTTIARTINEVENQILTRDAKGISQEQMNEFRASFNHFDRDHSGTLGPEEFKACLISLGYDIGNDPQGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 894754 - protein, 578 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQLQNTGFKRFCQELRKLMLWEVTWVVSLWSSPSP

SEQ ID NO: 894755 - protein, 504 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGPPPNWGYSRYDQHACSV

SEQ ID NO: 894756 - protein, 426 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLREKGYEERT

SEQ ID NO: 894757 - protein, 71 aa, Homo sapiens
RILKEAMTWSAVSVSAGDKNYITMDELRRELPPDQAEYCIARMAPYTGPDSVPGALDYMSFSTALYGESDL

SEQ ID NO: 894758 - protein, 69 aa, Homo sapiens
VYLLIHTHVTYRPGTLQNYITMDELRRELPPDQAEYCIARMAPYTGPDSVPGALDYMSFSTALYGESDL

SEQ ID NO: 894759 - protein, 458 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSGEPGGEPGPPDWTASTSELLLVVVKFSFMGVRMGVFASTYIHCSRSHFPLPVTTQAQSQTRPCGAAPSAQTILGQACPSRPLSIYSRPPSHKKSSL

SEQ ID NO: 894760 - protein, 370 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSKRITRSKRVMRVAERHRATEES

SEQ ID NO: 894761 - protein, 322 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQVSWGPRGIDPPCPRSDSLQNYFLQKRKKSYVKNQKTTYFIIEKVFFLHQTNGKKEERLTICTEMSCFVAT

SEQ ID NO: 894762 - protein, 95 aa, Homo sapiens
GHVVQSTWHGVGAGVGAIRAMQYSAWVLWTTCPSPRRCTARVTSNPPRPAALVLCAVPCLAPPPSPISCLGSVSAPSLHPGELGPTWHRSSLPAK

SEQ ID NO: 894763 - protein, 217 aa, Homo sapiens
ILPISSILVWIQAKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRKKTGMMDTDDFRACLISMGYNMVSWGPRGIDPPCPRSDSLQNYFLQKRKKSYVKNQKTTYFIIEKVFFLHQTNGKKEERLTICTEMSCFVAT

SEQ ID NO: 894764 - protein, 319 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKRRHSSTQSPILPRRRPATQRRPSSPGRHEKTARTGPAPRHTRGETAPTPPPPRRPGRHGNGTAQA

SEQ ID NO: 894765 - protein, 42 aa, Homo sapiens
MHGTLEDQLSHLRQYEKSIVNYKPKIDQLEGDHQLIQEALIF

SEQ ID NO: 894766 - protein, 888 aa, Homo sapiens
APPPWRRVSPAPALPAPRAPARRTVGAASLDSALGNGSASRFGQPLRRPWARITVARFPQREVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 894767 - protein, 140 aa, Homo sapiens
FLVGSGSVRTGHMERDPLNLLPRKSVLPGPEIAKCNYFSGEKYYLSAFLSSSLHRSWIKRCSRICQKTEEVGKNERNKGTAHKVRQRWQEGMTEVQCGKVAFQFQCSSDSTNGTGVQGGQIPELIFYDLRCPGRLQQVSE

SEQ ID NO: 894768 - protein, 833 aa, Homo sapiens [sequence omitted]

SEQ ID NO: 894769 - protein, 833 aa, Homo sapiens [sequence omitted]

SEQ ID NO: 894770 - protein, 799 aa, Homo sapiens
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQADREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 894771 - protein, 550 aa, Homo sapiens
MQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 894772 - protein, 736 aa, Homo sapiens
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRSWIKRCSRICQKTEEVGKNERNKGTAHKVRQRWQWGLPWQKRRKC

SEQ ID NO: 894773 - protein, 106 aa, Homo sapiens
MKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 894774 - protein, 106 aa, Homo sapiens; identical to SEQ ID NO: 894773

SEQ ID NO: 894775 - protein, 796 aa, Homo sapiens
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDASYVDPLGPQIERPKTAAKKRIDEDDFADEELGDDLLPE

SEQ ID NO: 894776 - protein, 119 aa, Homo sapiens
GYVIRSRVRMSGKKKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 894777 - protein, 573 aa, Homo sapiens
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANMYLI

SEQ ID NO: 894778 - protein, 238 aa, Homo sapiens
MRFKNRFQRFMNHRAPANGRYKPTCYEHAANCYTHAFLIVPAIVGSALLHRLSDDCWEKITAWIYGMGLCALFIVSTVFHIVSWKKSHLRTVEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 894779 - protein, 84 aa, Homo sapiens
AGLRGGAQEPRGGGAGEAGGGRREVLGPLKRPPSRPQPPGLAPALSRPAAWPTPTLPGRRVPLDTQAASGAAQAHEGRAPGRRC

SEQ ID NO: 894780 - protein, 102 aa, Homo sapiens
MGAPASPGSPLAICGPQMDSRPRDSKPVLLPGDPFAPGAHPPDPHTGWALALSGNPNPSPGHRPRVLRPGFGLHPFTSRVGVSRGARNGVAPCGEICRKAGC

SEQ ID NO: 894781 - protein, 238 aa, Homo sapiens; identical to SEQ ID NO: 894778

SEQ ID NO: 894782 - protein, 205 aa, Homo sapiens
MAATSQLAMNMLLTVTHTQSDDCWEKITAWIYGMGLCALFIVSTVFHIVSWKKSHLRTVEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 894783 - protein, 238 aa, Homo sapiens; identical to SEQ ID NO: 894778

SEQ ID NO: 894784 - protein, 1380 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 894785 - protein, 353 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGMQSIEFATFSPLFVEFCYVYS

SEQ ID NO: 894786 - protein, 1380 aa, Homo sapiens; identical to SEQ ID NO: 894784

SEQ ID NO: 894787 - protein, 1380 aa, Homo sapiens; identical to SEQ ID NO: 894784

SEQ ID NO: 894788 - protein, 1380 aa, Homo sapiens; identical to SEQ ID NO: 894784

SEQ ID NO: 894789 - protein, 1380 aa, Homo sapiens; identical to SEQ ID NO: 894784

SEQ ID NO: 894790 - protein, 1380 aa, Homo sapiens; identical to SEQ ID NO: 894784

SEQ ID NO: 894791 - protein, 1134 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNRLCAS

SEQ ID NO: 894792 - protein, 1380 aa, Homo sapiens; identical to SEQ ID NO: 894784

SEQ ID NO: 894793 - protein, 462 aa, Homo sapiens [sequence omitted]

SEQ ID NO: 894794 - protein, 369 aa, Homo sapiens
FDGDSLSPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 894795 - protein, 974 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTKGPKNLLLSSQIVFYIH

SEQ ID NO: 894796 - protein, 655 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRMHFFSVSPRDFPFPWSYGGK

SEQ ID NO: 894797 - protein, 1413 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTLHPETLCIQRHFASRDTLHPEALCIQRHFASRGTLHPETLCIQ

SEQ ID NO: 894798 - protein, 848 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARG

SEQ ID NO: 894799 - protein, 725 aa, Homo sapiens
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKVGLSLNIKCYKINSFI

SEQ ID NO: 894800 - protein, 329 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 894801 - protein, 329 aa, Homo sapiens; identical to SEQ ID NO: 894800

SEQ ID NO: 894802 - protein, 80 aa, Homo sapiens
GCKGQEAGGTEVHTAPEKCALPHDHTHQTEAKRSTACIRTPTPEQHELQQESESNQRTGSGTLILPLSIAVHCQGDHPAL

SEQ ID NO: 894803 - protein, 329 aa, Homo sapiens; identical to SEQ ID NO: 894800

SEQ ID NO: 894804 - protein, 337 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEVWKCDSQPALTPSPCAFF

SEQ ID NO: 894805 - protein, 263 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDMEDNEMSCSP

SEQ ID NO: 894806 - protein, 329 aa, Homo sapiens; identical to SEQ ID NO: 894800

SEQ ID NO: 894807 - protein, 363 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIGQWGGGARQAEGDLWDADCTRRKRQSCLIHLPLAEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 894808 - protein, 329 aa, Homo sapiens; identical to SEQ ID NO: 894800

SEQ ID NO: 894809 - protein, 329 aa, Homo sapiens; identical to SEQ ID NO: 894800

SEQ ID NO: 894810 - protein, 329 aa, Homo sapiens; identical to SEQ ID NO: 894800

SEQ ID NO: 894811 - protein, 337 aa, Homo sapiens; identical to SEQ ID NO: 894804

SEQ ID NO: 894812 - protein, 357 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAVSNLATPDPLWPPPGCLHLSLSRLSCPQALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 894813 - protein, 337 aa, Homo sapiens; identical to SEQ ID NO: 894804

SEQ ID NO: 894814 - protein, 251 aa, Homo sapiens
MAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 894815 - protein, 251 aa, Homo sapiens; identical to SEQ ID NO: 894814

SEQ ID NO: 894816 - protein, 300 aa, Homo sapiens [sequence omitted]

SEQ ID NO: 894817 - protein, 220 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIETSPEEGSATTLKTTRKETMKVCLYCSGNS

SEQ ID NO: 894818 - protein, 305 aa, Homo sapiens [sequence omitted]

SEQ ID NO: 894819 - protein, 233 aa, Homo sapiens
MQAQLLLAALNIATHVLKPGGCFVAKIFRGRDVTLLYSQLQVFFSSVLCAKPRSSRNSSIGQWGGGARQAEGDLWDADCTRRKRQSCLIHLPLAEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 894820 - protein, 371 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIGQWGGGARQAEGDLWDADCTRRKRQSCLIHLPLAEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEVWKCDSQPALTPSPCAFF

SEQ ID NO: 894821 - protein, 154 aa, Homo sapiens
MQLLFPMWFFDCERNALKKVSVFVFSSMHFPDSETNTLSGPFLYPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 894822 - protein, 334 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIGQWGGGARQAEGDLWDADCTRRKRQSCLIHLPLAEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPSVPHPAGP

SEQ ID NO: 894823 - protein, 111 aa, Homo sapiens
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRKACPLQPDHTNDEKE

SEQ ID NO: 894824 - protein, 111 aa, Homo sapiens; identical to SEQ ID NO: 894823

SEQ ID NO: 894825 - protein, 127 aa, Homo sapiens
KVILLFWIARLSSPSCWGPGLGVGTLLPLLNTLFCLSSQWWLLEPPERCCGSSTSATNSTSVSSRKAENKYAGGNPVCVRPTPKWQKGIGEFFRLSPKDSEKENQIPEEAGSSGLGKAKRKACPCAT

SEQ ID NO: 894826 - protein, 104 aa, Homo sapiens
MVLCKIKQHVEGIVSAWWLLEPPERCCGSSTSATNSTSVSSRKAENKYAGGNPVCVRPTPKWQKGIGEFFRLSPKDSEKENQIPEEAGSSGLGKAKRKACPCAT

SEQ ID NO: 894827 - protein, 111 aa, Homo sapiens; identical to SEQ ID NO: 894823

SEQ ID NO: 894828 - protein, 399 aa, Homo sapiens
MSQVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 894829 - protein, 399 aa, Homo sapiens; identical to SEQ ID NO: 894828

SEQ ID NO: 894830 - protein, 131 aa, Homo sapiens
MSQVTFSDVAIDFSHEEWACLDSAQRDLYKDVMVQNYENLVSVGLSVTKPYVIMLLEDGKEPWMMEKKLSKAYPFPLSHSVPASVNFGFSALFEHCSEVTEIFELSELCVFWVLHFLSNSPNSTVEAFFKK

SEQ ID NO: 894831 - protein, 131 aa, Homo sapiens; identical to SEQ ID NO: 894830

SEQ ID NO: 894832 - protein, 368 aa, Homo sapiens
MPRFCSEGLIQGCLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 894833 - protein, 87 aa, Homo sapiens [sequence omitted]

SEQ ID NO: 894834 - protein, 131 aa, Homo sapiens; identical to SEQ ID NO: 894830

SEQ ID NO: 894835 - protein, 105 aa, Homo sapiens
MSQRQYPECYLAPNGCLVSNCGVNKMSNEELVGQNHGMEGEACTGGDVTFSDVAIDFSHEEWACLDSAQRDLYKDVMVQNYENLVSVGKDITPSTPIGDTFLLPP

SEQ ID NO: 894836 - protein, 399 aa, Homo sapiens; identical to SEQ ID NO: 894828

SEQ ID NO: 894837 - protein, 199 aa, Homo sapiens
MSQVTFSDVAIDFSHEEWACLDSAQRDLYKDVMVQNYENLVSVGLSVTKPYVIMLLEDGKEPWMMEKKLSKDWESRWENKELSTKKDIYDEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREN

SEQ ID NO: 894838 - protein, 944 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 894839 - protein, 973 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVVVSRQLPGLLPNTALTPPTPLVGLCSLWQELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 894840 - protein, 1017 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITVRGGAGLPGPQAVAGSPDSLHQAPPQPLSLPRASLVKMYGSWPGLLLRSHIGGAGGAGPGHPALVPAVFPPVQIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 894841 - protein, 1046 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVVVSRQLPGLLPNTALTPPTPLVGLCSLWQELTPDYSMESHQRDHENYVACSRSHRRRAKALLDFERHDDDELGFRKNDIITVRGGAGLPGPQAVAGSPDSLHQAPPQPLSLPRASLVKMYGSWPGLLLRSHIGGAGGAGPGHPALVPAVFPPVQIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 894842 - protein, 988 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVVVSRQLPGLLPNTALTPPTPLVGLCSLWQELTPDYSMESHQRDHENYVACSRSHRRRAKALLDFERHDDDELGFRKNDIITVRGGAGLQIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRSFGVTLRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 894843 - protein, 858 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLK

SEQ ID NO: 894844 - protein, 952 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREGGWCGPRRACTDGAAQTVRGVAKVGTRSAGVSG

SEQ ID NO: 894845 - protein, 921 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRSFGVLLRLDEDGKVLTPEELLYRAVQSVNVTHDAVHAQMDVKLRSLICVGLNPGWVQIKCELRVLCCFAFSLSQDWELPAKREAQQPLKEGVRDMLVKHHLFSWDVDG

SEQ ID NO: 894846 - protein, 944 aa, Homo sapiens; identical to SEQ ID NO: 894838

SEQ ID NO: 894847 - protein, 952 aa, Homo sapiens; identical to SEQ ID NO: 894844

SEQ ID NO: 894848 - protein, 952 aa, Homo sapiens; identical to SEQ ID NO: 894844

SEQ ID NO: 894849 - protein, 944 aa, Homo sapiens; identical to SEQ ID NO: 894838

SEQ ID NO: 894850 - protein, 934 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKRELGLQSCIQVQGSALP

SEQ ID NO: 894851 - protein, 741 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITVRGGAGLPGPQAVAGSPDSLHQAPPQPLSLPRASLVKM

SEQ ID NO: 894852 - protein, 828 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVVVSRQLPGLLPNTALTPPTPLVGLCSLWQELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTSRALAGAAGYQYQAAPLHVPQHIPGGGSRGYPAPPGSLGML

SEQ ID NO: 894853 - protein, 132 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVRWPQGPTGC

SEQ ID NO: 894854 - protein, 68 aa, Homo sapiens
GLSQTHPSHQYSIAGDDSVTEGVTDLVRGTLCPALKALFEHGLKKPSLLGGACHPWLFIEEVSQWLGP

SEQ ID NO: 894855 - protein, 952 aa, Homo sapiens; identical to SEQ ID NO: 894844

SEQ ID NO: 894856 - protein, 870 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRSRALAGAAGYQYQAAPLHVPQHIPGGGSRGYPAPPGSLGML

SEQ ID NO: 894857 - protein, 808 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQVKVATGTHRVLRGSWPHDQVSRERLSALAAPFPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVAQDGGPHLDPQHTGRRGHLEVQSAGAAENKPALPALPPSLAQSDHSCGVIQASSGFVHLQVLILARFGRKADPALIICFQFLEPASEAISDEKYKPRAGGFSSSRGQDHPDPLLLVQVVRRRTQRRKSTITALLFGESSASARQCGHAGVCPHAHVDVELPPRGPGVGCGHHGSLGLLGEDDLEALKAKNIKQTELVADLREAILRVARHFQCTDPKNCSVVVSRQLPGLLPNTALTPPTPLVGLCSLWQELTPDYSMESHQRDHENYVACSRSHRRRAKALLDFERHDDDELGFRKNDIITIVSQKDEHCWVGELNGLRGWFPAKFVEVLDERSKESRALAGAAGYQYQAAPLHVPQHIPGGGSRGYPAPPGSLGML

SEQ ID NO: 894858 - protein, 906 aa, Homo sapiens
PAARPRPKRRPRRRLRNVCGEPPPPPVPTPMMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 894859 - protein, 240 aa, Homo sapiens
MAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 894860 - protein, 826 aa, Homo sapiens
PAARPRPKRRPRRRLRNVCGEPPPPPVPTPMMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLADDGGGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKENFTAILYRTLERRRLADDINQKDGPGEASAWRILRAKLPINNCSTE

SEQ ID NO: 894861 - protein, 283 aa, Homo sapiens
MNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 894862 - protein, 276 aa, Homo sapiens
PAARPRPKRRPRRRLRNVCGEPPPPPVPTPMMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRG

SEQ ID NO: 894863 - protein, 253 aa, Homo sapiens
MISSCTTRKMAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGKLASFAWKTSFMKLPSQGSISRRSHGSCALSTSQWPVMLPKIEWASSRRWAHLAIGVNASISSSVS

SEQ ID NO: 894864 - protein, 253 aa, Homo sapiens; identical to SEQ ID NO: 894863

SEQ ID NO: 894865 - protein, 115 aa, Homo sapiens
MLRIVEPYVTWGFPNLKSVRELILKRGQAKVKNKTIPLTDNTVIEEHLGKLASFAWKTSFMKLPSQGSISRRSHGSCALSTSQWPVMLPKIEWASSRRWAHLAIGVNASISSSVS

SEQ ID NO: 894866 - protein, 253 aa, Homo sapiens; identical to SEQ ID NO: 894863

SEQ ID NO: 894867 - protein, 115 aa, Homo sapiens; identical to SEQ ID NO: 894865

SEQ ID NO: 894868 - protein, 253 aa, Homo sapiens; identical to SEQ ID NO: 894863

SEQ ID NO: 894869 - protein, 115 aa, Homo sapiens; identical to SEQ ID NO: 894865

SEQ ID NO: 894870 - protein, 205 aa, Homo sapiens
MISSCTTRKMAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGECYSLGVSWGRKPGSLKL

SEQ ID NO: 894871 - protein, 253 aa, Homo sapiens; identical to SEQ ID NO: 894863

SEQ ID NO: 894872 - protein, 253 aa, Homo sapiens; identical to SEQ ID NO: 894863

SEQ ID NO: 894873 - protein, 253 aa, Homo sapiens; identical to SEQ ID NO: 894863

SEQ ID NO: 894874 - protein, 253 aa, Homo sapiens; identical to SEQ ID NO: 894863

SEQ ID NO: 894875 - protein, 253 aa, Homo sapiens; identical to SEQ ID NO: 894863

SEQ ID NO: 894876 - protein, 253 aa, Homo sapiens; identical to SEQ ID NO: 894863

SEQ ID NO: 894877 - protein, 253 aa, Homo sapiens; identical to SEQ ID NO: 894863

SEQ ID NO: 894878 - protein, 253 aa, Homo sapiens; identical to SEQ ID NO: 894863

SEQ ID NO: 894879 - protein, 115 aa, Homo sapiens; identical to SEQ ID NO: 894865

SEQ ID NO: 894880 - protein, 253 aa, Homo sapiens; identical to SEQ ID NO: 894863

SEQ ID NO: 894881 - protein, 253 aa, Homo sapiens; identical to SEQ ID NO: 894863

SEQ ID NO: 894882 - protein, 253 aa, Homo sapiens; identical to SEQ ID NO: 894863

SEQ ID NO: 894883 - protein, 253 aa, Homo sapiens; identical to SEQ ID NO: 894863

SEQ ID NO: 894884 - protein, 253 aa, Homo sapiens; identical to SEQ ID NO: 894863

SEQ ID NO: 894885 - protein, 173 aa, Homo sapiens
MISSCTTRKMAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGYRYESPCPQDLVYFFRGKYTQGF

SEQ ID NO: 894886 - protein, 150 aa, Homo sapiens
MISSCTTRKMAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWG

SEQ ID NO: 894887 - protein, 70 aa, Homo sapiens
ESHAGGGRSRISDPPGLQEIRHELVPIRHEPHPKLLHYNLPQLMPSSLSSSSSQRDFFVNGFIEDIIYIL

SEQ ID NO: 894888 - protein, 1560 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 894889 - protein, 1560 aa, Homo sapiens; identical to SEQ ID NO: 894888

SEQ ID NO: 894890 - protein, 1560 aa, Homo sapiens; identical to SEQ ID NO: 894888

SEQ ID NO: 894891 - protein, 1560 aa, Homo sapiens; identical to SEQ ID NO: 894888

SEQ ID NO: 894892 - protein, 1490 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVLASSALRGPIPPHPHCWPGGEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 894893 - protein, 1542 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKTDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 894894 - protein, 1560 aa, Homo sapiens; identical to SEQ ID NO: 894888

SEQ ID NO: 894895 - protein, 1553 aa, Homo sapiens
PPILCHHSQASQHLPPPPGASSPASSCTRQVYERGSTGSLPDWDWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 894896 - protein, 1531 aa, Homo sapiens
MGSGSLGETLGSESVECCIPLFSPKTGPKDSGQWEGVASLFEPFLLQAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 894897 - protein, 1560 aa, Homo sapiens; identical to SEQ ID NO: 894888

SEQ ID NO: 894898 - protein, 1560 aa, Homo sapiens; identical to SEQ ID NO: 894888

SEQ ID NO: 894899 - protein, 1560 aa, Homo sapiens; identical to SEQ ID NO: 894888

SEQ ID NO: 894900 - protein, 1560 aa, Homo sapiens; identical to SEQ ID NO: 894888

SEQ ID NO: 894901 - protein, 1560 aa, Homo sapiens; identical to SEQ ID NO: 894888

SEQ ID NO: 894902 - protein, 685 aa, Homo sapiens
MPVVPATREAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 894903 - protein, 1044 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPTPESLDFCILTPRYCSDLSSWGPAPGVFPPW

SEQ ID NO: 894904 - protein, 1452 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLEETNHQASQRESRN

SEQ ID NO: 894905 - protein, 890 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKVRTLGVLMRDQGDQGT

SEQ ID NO: 894906 - protein, 772 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHIKQAGLLAALHVGLGSSQPLLQALLAFSVRCAALLQLVQ

SEQ ID NO: 894907 - protein, 541 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTCSGAHIRS

SEQ ID NO: 894908 - protein, 326 aa, Homo sapiens [sequence omitted]

SEQ ID NO: 894909 - protein, 163 aa, Homo sapiens
GVLRGGPEKGRGRLLTHLLLSWVWQIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTER

SEQ ID NO: 894910 - protein, 250 aa, Homo sapiens
MPSPDSMTFEDIIVDFTQEEWALLDTSQRKLFQDVMLENISHLVSIGKQLCKSVVLSQLEQVEKLSTQRISLLQGREVGIKHQEIPFIQHIYQKGTSTISTMRSHTQEDPFLCNDLGEDFTQHIALTQNVITYMRTKHFVSKKFGKIFSDWLSFNQHKEIHTKCKSYGSHLFDYAFIQNSALRPHSVTHTREITLECRVCGKTFSKNSNLRRHEMIHTGEKPHGCHLCGKAFTHCSDLRKHERTHTGEKP

SEQ ID NO: 894911 - protein, 356 aa, Homo sapiens
LATGHWKRLRRDNPRFNLMLGERNRLPFGRLGHEPGLVQLVNYYRGADKLCRKASLVKLIKTSPELAESCTWFPESYVIYPTNLKTPVAPAQNGIQPPISNSRTDEREFFLASYNRKKEDGEGNVWIAKSSAGAKGEGILISSEASELLDFIDNQGQVHVIQKYLEHPLLLEPGHRKFDIRSWVLVDHQYNIYLYREGVLRTASEPYHVDNFQDKTCHLTNHCIQKEYSKNYGKYEEGNEMFFKEFNQYLTSALNITLESSILLQIKHIIRNCLLSVEPAISTKHLPYQSFQLFGFDFMVDEELKVWLIEVNGAPACAQKLYAELCQGIVDIAISSVFPPPDVEQPQTQPAAFIKL

SEQ ID NO: 894912 - protein, 356 aa, Homo sapiens; identical to SEQ ID NO: 894911

SEQ ID NO: 894913 - protein, 319 aa, Homo sapiens
LATGHWKRLRRDNPRFNLMLGERNRLPFGRLGHEPGLVQLVNYYRGADKLCRKASLVKLIKTSPELAESCTWFPESYVIYPTNLKTPVAPAQNGIQPPISNSRTDEREFFLASYNRKKEDGEGNVWIAKSSAGAKGEGILISSEASELLDFIDNQGQVHVIQKYLEHPLLLEPGHRKFDIRSWVLVDHQYNIYLYREGVLRTASEPYHVDNFQDKTCHLTNHCIQKEYSKNYGKYEEGNEMFFKEFNQYLTSALNITLESSILLQIKHIIRNCLLSVEPAISTKHLPYQSFQLFGFDFMVDEELKVWLIEVNGAPACAQ

SEQ ID NO: 894914 - protein, 247 aa, Homo sapiens
LATGHWKRLRRDNPRFNLMLGERNRLPFGRLGHEPGLVQLVNYYRGADKLCRKASLVKLIKTSPELAESCTWFPESYVIYPTNLKTPVAPAQNGIQPPISNSRTDEREFFLASYNRKKEDGEGNVWIAKSSAGAKGEGILISSEASELLDFIDNQGQVHVIQKYLEHPLLLEPGHRKFDIRSWVLVDEVFKRRGHDIVIFGLMWYGCSVWRKFERKNCQLAGQQGSHLYLARRTWIEAMDDGFQSNL

SEQ ID NO: 894915 - protein, 181 aa, Homo sapiens
LATGHWKRLRRDNPRFNLMLGERNRLPFGRLGHEPGLVQLVNYYRGADKLCRKASLVKLIKTSPELAESCTWFPESYVIYPTNLKTPVAPAQNGIQPPISNSRTDEREFFLASYNRKKEDGEGNVWIAKSSAGAKGEGILISSEASELLDFIDNQGQVHVIQKYLEHPLLLEPGHRKFDIR

SEQ ID NO: 894916 - protein, 941 aa, Homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 894917 - protein, 236 aa, Homo sapiens
SASASPSPGAHGSSPSLEAARAAPEQPRLRLPRFLPSALPRPSSRGCRLAAPGGRAVQSAHGGGRRRPGAGRPRWREARAETPAPLSAFARLLPASRTPLAPTPSRRDWSVTGADRSTATARAACYCYCCCRCCCLWRPGPGARARGAPPGPNAQTDRTVIHHGPHADHQREWPKGSIRGSGVTPPPLELAIEQIRKRVISCDPYFHRPAGSMTRSCDNAKGLKAFYDAIKYGPNH

SEQ ID NO: 894918 - protein, 941 aa, Homo sapiens; identical to SEQ ID NO: 894916

SEQ ID NO: 894919 - protein, 941 aa, Homo sapiens; identical to SEQ ID NO: 894916

SEQ ID NO: 894920 - protein, 926 aa, Homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHACATLLPSHGLGPVRVGGLGPGPPP

SEQ ID NO: 894921 - protein, 233 aa, Homo sapiens
MSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHACATLLPSHGLGPVRVGGLGPGPPP

SEQ ID NO: 894922 - protein, 855 aa, Homo sapiens
REETVLGELRESREGSLEEVSVSRPGQMSRKYDPRSKKCCILSHSKTRAGAPAPPTPDRCDFNLWTDQRCHIDMRRHDFCSELSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHACATLLPSHGLGPVRVGGLGPGPPP

SEQ ID NO: 894923 - protein, 684 aa, Homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEVSPPCRQEGSLQMQPLAHEDSEAAQLPDCPVPHWEHFISSISFHLRHVIPGRP

SEQ ID NO: 894924 - protein, 572 aa, Homo sapiens
RSGSGSVAQSVSGCPARVVGGKDSGSVLTRPWPEAQGPPPLPPSPPASPPSPELDRTPWDTVFHFLRTSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 894925 - protein, 554 aa, Homo sapiens
GGEGSLLTGGSSARQCHQWASRLTDSPPASPPSPELDRTPWDTVFHFLRTSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 894926 - protein, 572 aa, Homo sapiens; identical to SEQ ID NO: 894924

SEQ ID NO: 894927 - protein, 572 aa, Homo sapiens; identical to SEQ ID NO: 894924

SEQ ID NO: 894928 - protein, 572 aa, Homo sapiens; identical to SEQ ID NO: 894924

SEQ ID NO: 894929 - protein, 593 aa, Homo sapiens
RSGSGSVAQSVSGCPARVVGGKDSGSVLTRPWPEAQGPPPLPPSPPASPPSPELDRTPWDTVFHFLRTSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTPSSLTRLYGPCSVSPTPWASQRVTAAQALTLGSRRHRAQHPGCCRQAEDTRILTCTFCPCLLPLASQWYLNKVCSYICPYFPVLQPPKSTCNSLLSPVIYLSSPLS

SEQ ID NO: 894930 - protein, 408 aa, Homo sapiens
RSGSGSVAQSVSGCPARVVGGKDSGSVLTRPWPEAQGPPPLPPSPPASPPSPELDRTPWDTVFHFLRTSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEMGKLKFARLMLRSAGARI

SEQ ID NO: 894931 - protein, 465 aa, Homo sapiens
RSGSGSVAQSVSGCPARVVGGKDSGSVLTRPWPEAQGPPPLPPSPPASPPSPELDRTPWDTVFHFLRTSPRLEERSEEVSAQPAPPWPAQAWDPAVRWREATPRPCPPPGSPLNPVGAELREEGKVEREDSLLRTPGRLGPGEQVVPRRATRAERARWATMGRKEAGTYSERRQLSPRGHRGGKAPRIDPDPHGGRPQSPNTDIRGHPRLRRYGRAESGTKTETEHAGGPRRRNLETKGPNKRKRRQGTGGRAGHGKRTERVSPRCLANPDRRIRTRSPRVASKSVYHGTLSPALEWPTVTPGSRRSPATTDTGHKGKAPGDGQRPGPTSETGPYPVLVVEAYSGRSSAARHRPRKGTQDNPGTRWSQTRARWTPGKREQSRGRQSYLGTGHGQQGTAAEQKAGRQISECKGKGIDNRLDNEMNSRPSRGQQETSRRGAIAGGVHPGHDKGRGRRQDTGVNKARP

SEQ ID NO: 894932 - protein, 101 aa, Homo sapiens
MTELRVGQGQSVETGDGWMAMRPWTLGRACQAVQLPQQSCRGPEGAPWGFRCQGKWLGEMALARADPTGQRGPVKDCGGRRVWWLTPVIPALWEAEEGRSR

SEQ ID NO: 894933 - protein, 572 aa, Homo sapiens; identical to SEQ ID NO: 894924

SEQ ID NO: 894934 - protein, 572 aa, Homo sapiens; identical to SEQ ID NO: 894924

SEQ ID NO: 894935 - protein, 248 aa, Homo sapiens
RSGSGSVAQSVSGCPARVVGGKDSGSVLTRPWPEAQGPPPLPPSPPASPPSPELDRTPWDTVFHFLRTSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPSISRPQFDYSDHQPSGPYYGHSGQASGLYSAFSYMGPSQRPLYTAISDPSPSGPQSHSPTHWEQPVYTTLSRP

SEQ ID NO: 894936 - protein, 593 aa, Homo sapiens; identical to SEQ ID NO: 894929

SEQ ID NO: 894937 - protein, 335 aa, Homo sapiens
RSGSGSVAQSVSGCPARVVGGKDSGSVLTRPWPEAQGPPPLPPSPPASPPSPELDRTPWDTVFHFLRTSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDPPRRVPLLTRPTRGLR

SEQ ID NO: 894938 - protein, 486 aa, Homo sapiens [sequence omitted]

SEQ ID NO: 894939 - protein, 440 aa, Homo sapiens
MFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLIMEPRLGQTPVTEAVSGRRGIAIAYEDEGSG

SEQ ID NO: 894940 - protein, 413 aa, Homo sapiens
MFILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 894941 - protein, 296 aa, Homo sapiens
MPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 894942 - protein, 486 aa, Homo sapiens [sequence omitted]

SEQ ID NO: 894943 - protein, 296 aa, Homo sapiens; identical to SEQ ID NO: 894941

SEQ ID NO: 894944 - protein, 296 aa, Homo sapiens; identical to SEQ ID NO: 894941

SEQ ID NO: 894945 - protein, 296 aa, Homo sapiens; identical to SEQ ID NO: 894941

SEQ ID NO: 894946 - protein, 296 aa, Homo sapiens; identical to SEQ ID NO: 894941

SEQ ID NO: 894947 - protein, 258 aa, Homo sapiens
MFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 894948 - protein, 423 aa, Homo sapiens
KASRGGGNRPRVILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 894949 - protein, 395 aa, Homo sapiens
MFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 894950 - protein, 78 aa, Homo sapiens
KPGARSQGVSMDFLSSSLSGSPFHVALPPPESELWETPDVSLITGDLRPPPAWKSSNDHGSLALTPRPQLELAESSPA

SEQ ID NO: 894951 - protein, 273 aa, Homo sapiens
IRLEARGDHAPGALLSSQGDSEALLRIMLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 894952 - protein, 102 aa, Homo sapiens
IRLEARGDHAPGALLSSQGDSEALLRIMLWRQLIYWQLLALFFLPFCLCQDEYMESPQTGGLPPDCSKCCHGDYSFRGYQGPPGPPGPPGIPGKDEQDILSI

SEQ ID NO: 894953 - protein, 273 aa, Homo sapiens; identical to SEQ ID NO: 894951

SEQ ID NO: 894954 - protein, 126 aa, Homo sapiens
MASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 894955 - protein, 1288 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 894956 - protein, 123 aa, Homo sapiens
MENIDRETLCPKISRKSCSWHTLRMRKRAEVENTGKNEATGPRKPKDILGNKVSVKETNSSEESECDDLDPNTSMEVEAAIVVLFPTMIAFFDVFCNSDLAKMTSHSKINCDVGASLGIPSQL

SEQ ID NO: 894957 - protein, 377 aa, Homo sapiens
MQSTPVLQFLFLLILLPVFQEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKNDLGGCNGTSSMAVIKDYYALKENEICVSQGEVVQVLAVNQQNMCLVYQPASDHSPAAEGWVPGSILAPLTKATAAESSDGSIK

SEQ ID NO: 894958 - protein, 147 aa, Homo sapiens [sequence omitted]

SEQ ID NO: 894959 - protein, 508 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINLSVDTLLLRYNCVPV

SEQ ID NO: 894960 - protein, 88 aa, Homo sapiens
KWLTSPVRRLNSGKADGNIKKQKKVRDGRKSFDLGSPKPGDETTPQGDSADEVLTGGPGVVHQEGLLTCLLPQVLSTRPSQISISVLP

SEQ ID NO: 894961 - protein, 668 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKNDLGGCNGTSSMAVIKDYYALKENEICVSQGEVVQVLAVNQQNMCLVYQPASDHSPAAEGWVPGSILAPLTKATAAESSDGSIK

SEQ ID NO: 894962 - protein, 1256 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 894963 - protein, 603 aa, Homo sapiens
MENIDRETLCPKISRKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 894964 - protein, 35 aa, Homo sapiens
MAVIKDYYALKENEICVSQGEVVQVLAVNQQNMCL

SEQ ID NO: 894965 - protein, 213 aa, Homo sapiens
MDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 894966 - protein, 236 aa, Homo sapiens
MEVGLPAITLFLTSASSPVVATTMDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 894967 - protein, 213 aa, Homo sapiens; identical to SEQ ID NO: 894965

SEQ ID NO: 894968 - protein, 213 aa, Homo sapiens; identical to SEQ ID NO: 894965

SEQ ID NO: 894969 - protein, 322 aa, Homo sapiens
MAYKFISACRNRKKSKFSTSPKNFNIANTGNGELTNRNTRKCKVLKLQNKNSNLGKAPNLPPQWWGLTQTLPGTLSPEAPRPGTTGTLVQSADARGGRCGASSPVVATTMDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 894970 - protein, 213 aa, Homo sapiens; identical to SEQ ID NO: 894965

SEQ ID NO: 894971 - protein, 181 aa, Homo sapiens [sequence omitted]

SEQ ID NO: 894972 - protein, 181 aa, Homo sapiens [sequence omitted]

SEQ ID NO: 894973 - protein, 155 aa, Homo sapiens
MDQEPVGGVERGEAVAASGAAAAAAFGESAGQTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 894974 - protein, 213 aa, Homo sapiens; identical to SEQ ID NO: 894965

SEQ ID NO: 894975 - protein, 134 aa, Homo sapiens
MAEFGFAVLDCLNSLLMPPYRVRSVQKPRSCGVTAPDAAGDGLRRGRDARLQVHVPEMTSQAVPGGDPRALDACLAGSDAPQGPAPPRPAPREPVVAPPRLQLASSRGAEPGGLGEARAGPAPQAGESPSQRLG

SEQ ID NO: 894976 - protein, 213 aa, Homo sapiens; identical to SEQ ID NO: 894965

SEQ ID NO: 894977 - protein, 213 aa, Homo sapiens; identical to SEQ ID NO: 894965

SEQ ID NO: 894978 - protein, 213 aa, Homo sapiens; identical to SEQ ID NO: 894965

SEQ ID NO: 894979 - protein, 213 aa, Homo sapiens; identical to SEQ ID NO: 894965

SEQ ID NO: 894980 - protein, 181 aa, Homo sapiens [sequence omitted]

SEQ ID NO: 894981 - protein, 181 aa, Homo sapiens [sequence omitted]

SEQ ID NO: 894982 - protein, 213 aa, Homo sapiens
FSSFHTAHWLLVHRRRHHRAAGAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 894983 - protein, 178 aa, Homo sapiens
MEVGLPAITLFLTSASSPVVATTMDQEPVGGVERGEAVAASGAAAAAAFGESAGQTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 894984 - protein, 134 aa, Homo sapiens; identical to SEQ ID NO: 894975

SEQ ID NO: 894985 - protein, 486 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEYKGHKILNIVDCTRPNGGRLPMKVALMMSDFAGGASGFPMTFSGGKFTEEWKAQFIKTERKKLLNYKARLVKNLQPRIYCPFAGYFVESHPSDKYIKETNTKNDPNELNNLIKKNSDVITWTPRPGATLDLGRMLKDRTDSKGIIEPPEGTKIYKDSWDFEPYLEILNAALGDEIFLHSSWIKEYFTWAGFKDYNLVVRMIETDEDFNPFPGGYDYLVDFLDLSFPKERPQREHPYEEIHSRVDVIRHVVKNGLLWDELYIGFQTRLQRDPDIYHHLFWNHFQIKLPLTPPNWKSFLMCCEQNGPAILQECKTT

SEQ ID NO: 894986 - protein, 486 aa, Homo sapiens; identical to SEQ ID NO: 894985

SEQ ID NO: 894987 - protein, 486 aa, Homo sapiens; identical to SEQ ID NO: 894985

SEQ ID NO: 894988 - protein, 221 aa, Homo sapiens [sequence omitted]

SEQ ID NO: 894989 - protein, 221 aa, Homo sapiens [sequence omitted]

SEQ ID NO: 894990 - protein, 221 aa, Homo sapiens [sequence omitted]

SEQ ID NO: 894991 - protein, 221 aa, Homo sapiens [sequence omitted]

SEQ ID NO: 894992 - protein, 226 aa, Homo sapiens [sequence omitted]

SEQ ID NO: 894993 - protein, 486 aa, Homo sapiens; identical to SEQ ID NO: 894985

SEQ ID NO: 894994 - protein, 486 aa, Homo sapiens; identical to SEQ ID NO: 894985

SEQ ID NO: 894995 - protein, 501 aa, Homo sapiens [sequence omitted]

SEQ ID NO: 894996 - protein, 221 aa, Homo sapiens [sequence omitted]

SEQ ID NO: 894997 - protein, 244 aa, Homo sapiens [sequence omitted]

SEQ ID NO: 894998 - protein, 221 aa, Homo sapiens [sequence omitted]

SEQ ID NO: 894999 - protein, 449 aa, Homo sapiens [sequence omitted]

SEQ ID NO: 895000 - protein, 1066 aa, Homo sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFGELEGTRPNKKFKCKHCLKIFRSTAGLHRHVNMYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 895001 - protein, 1066 aa, Homo sapiens; identical to SEQ ID NO: 895000

SEQ ID NO: 895002 - protein, 865 aa, Homo sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 895003 - protein, 1059 aa, Homo sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFGELEGTRPNKKFKCKHCLKIFRSTAGLHRHVNMYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPLPKIQPLEPDSPTGLSENPTPATEKLFVPQESDTLFYHAPPLSAITFKRQFMCKLCHRTFKTAFSLWSHEQTHN

SEQ ID NO: 895004 - protein, 1066 aa, Homo sapiens; identical to SEQ ID NO: 895000

SEQ ID NO: 895005 - protein, 500 aa, Homo sapiens
MYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 895006 - protein, 747 aa, Homo sapiens
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLMLLQMAGVGLGSLAVVIILTFLSFSAV

SEQ ID NO: 895007 - protein, 595 aa, Homo sapiens [sequence omitted]

SEQ ID NO: 895008 - protein, 134 aa, Homo sapiens
MREDDRRGWFLLLLAQAVWPRVLQVLGDPQLRHRDLLEARFVTHAAADGGCWTGFPGCCDHSHIPLLLKRCDGRWTLSGEDALLLGRCSGSFSGARTEAPCDFRPGSMWACNFLHSQLGPIPGFKMVAIPEESP

SEQ ID NO: 895009 - protein, 747 aa, Homo sapiens; identical to SEQ ID NO: 895006

SEQ ID NO: 895010 - protein, 648 aa, Homo sapiens
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKKAITDAAMMAEELKKEQDNSHLERMKNLGTDGEGPAAS

SEQ ID NO: 895011 - protein, 215 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 895012 - protein, 215 aa, Homo sapiens; identical to SEQ ID NO: 895011

SEQ ID NO: 895013 - protein, 215 aa, Homo sapiens; identical to SEQ ID NO: 895011

SEQ ID NO: 895014 - protein, 268 aa, Homo sapiens
CCGIHVICTGADVGTGPSACPLSPRLGLVCSGSWAPNSWSSFFQDRKRRGNLDMEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 895015 - protein, 83 aa, Homo sapiens
CCGIHVICTGADVGTGPSACPLSPRLGLVCSGSWAPNSWSSFFQVCASVVPSALRSLKRRSNLSRIPAGQEKEGKSRHGKTLQ

SEQ ID NO: 895016 - protein, 268 aa, Homo sapiens; identical to SEQ ID NO: 895014

SEQ ID NO: 895017 - protein, 245 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDLLPKSSIRWCGPETENSRYVLRIKQATTDILDLVEPCLQRPEVGRKWAANWQKPFGR

SEQ ID NO: 895018 - protein, 215 aa, Homo sapiens; identical to SEQ ID NO: 895011

SEQ ID NO: 895019 - protein, 70 aa, Homo sapiens
CCGIHVICTGADVGTGPSACPLSPRLGLVCSGSWAPNSWSSFFQVCASVVPSALRSLKRRSNLSRIPAGP

SEQ ID NO: 895020 - protein, 215 aa, Homo sapiens; identical to SEQ ID NO: 895011

SEQ ID NO: 895021 - protein, 253 aa, Homo sapiens
VLSRPAFHPMHSVSHVSSLSPLSSTPIPQDRKRRGNLDMEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 895022 - protein, 83 aa, Homo sapiens; identical to SEQ ID NO: 895015

SEQ ID NO: 895023 - protein, 197 aa, Homo sapiens
MEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRPFYPRGPREFRGGCRAPRRDIEDIPYV

SEQ ID NO: 895024 - protein, 346 aa, Homo sapiens
MCEGPSRISGPIPPDPTLCPDNYRRPTSAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRSPKYDKVESRVKAQLQEPGPASGTESAHFLRAHSRCGPGLPPPHVSSPQPTPPGPEAKEPGLGVDFIRHNARAAKRAPRRHSCSLQVLAQVLEQQRQAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 895025 - protein, 346 aa, Homo sapiens; identical to SEQ ID NO: 895024

SEQ ID NO: 895026 - protein, 367 aa, Homo sapiens
EEEAKQLAEEMNIAFYTSRTDDILLHQDVDLVCISIPPPLTRQISVKALAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRSPKYDKVESRVKAQLQEPGPASGTESAHFLRAHSRCGPGLPPPHVSSPQPTPPGPEAKEPGLGVDFIRHNARAAKRAPRRHSCSLQVLAQVLEQQRQAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 895027 - protein, 136 aa, Homo sapiens
RLPGNNKSRRVAAAGGKTSRVSPCPSAAGERPRAGPRSGLGAEVAEVASEAGAQAGTGRGPGVAGTPGSRAPRGKRAEAGLADFRPGPGHHRSPWPLHRSRCRRDPGARPARRRGRAVATRGDLPRSWGLSQEEGP

SEQ ID NO: 895028 - protein, 123 aa, Homo sapiens
MCEGPSRISGPIPPDPTLCPDNYRRPTSAQGRLEGNALKLDLLTSDRALDTTAPRGPCIGPGAGEILERGQRGVGDVLLQLEGISLGPGASLKRAWPCLWDRVCPLPAGALPLRPWPPTTPCI

SEQ ID NO: 895029 - protein, 304 aa, Homo sapiens
MCEGPSRISGPIPPDPTLCPDNYRRPTSAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRSPKYDKVESRVKAQLQEPGLGVDFIRHNARAAKRAPRRHSCSLQVLAQVLEQQRQAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 895030 - protein, 161 aa, Homo sapiens
MCEGPSRISGPIPPDPTLCPDNYRRPTSAQGRLEGNALKLDLLTSDRAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 895031 - protein, 140 aa, Homo sapiens
MCEGPSRISGPIPPDPTLCPDNYRRPTSAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRTTPCI

SEQ ID NO: 895032 - protein, 202 aa, Homo sapiens
YHDTLTATGTDLQHKLILTETTPPKRPLEHSTPPNSKIDRKTPPGPEAKEPGLGVDFIRHNARAAKRAPRRHSCSLQVLAQVLEQQRQAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 895033 - protein, 44 aa, Homo sapiens
MCEGPSRISGPIPPDPTLCPDNYRRPTSGESGGLAVVRGSGVGP

SEQ ID NO: 895034 - protein, 412 aa, Homo sapiens
PPPCTAANRLVRVPGARYKTCAGRDRQAPDQGKASSANLQRRKSRLVKARGESLSMQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 895035 - protein, 412 aa, Homo sapiens; identical to SEQ ID NO: 895034

SEQ ID NO: 895036 - protein, 412 aa, Homo sapiens; identical to SEQ ID NO: 895034

SEQ ID NO: 895037 - protein, 412 aa, Homo sapiens; identical to SEQ ID NO: 895034

SEQ ID NO: 895038 - protein, 136 aa, Homo sapiens
MGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 895039 - protein, 76 aa, Homo sapiens
PPPCTAANRLVRVPGARYKTCAGRDRQAPDQGKASSANLQRRKSRLVKARGESHPPAVQELHQPAHLQAQVLWGLQ

SEQ ID NO: 895040 - protein, 412 aa, Homo sapiens; identical to SEQ ID NO: 895034

SEQ ID NO: 895041 - protein, 425 aa, Homo sapiens
SRVPARPAALPAPRPQPSAPALCRGARAVGRMSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 895042 - protein, 230 aa, Homo sapiens
SRVPARPAALPAPRPQPSAPALCRGARAVGRMSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGRYVEIGVSFIMQLSEVTLSCESREAHSNVEVRVEEGGERDGDED

SEQ ID NO: 895043 - protein, 193 aa, Homo sapiens
MIQAILVFNNHGKPRLVRFYQRFPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 895044 - protein, 193 aa, Homo sapiens; identical to SEQ ID NO: 895043

SEQ ID NO: 895045 - protein, 193 aa, Homo sapiens; identical to SEQ ID NO: 895043

SEQ ID NO: 895046 - protein, 193 aa, Homo sapiens; identical to SEQ ID NO: 895043

SEQ ID NO: 895047 - protein, 193 aa, Homo sapiens; identical to SEQ ID NO: 895043

SEQ ID NO: 895048 - protein, 193 aa, Homo sapiens; identical to SEQ ID NO: 895043

SEQ ID NO: 895049 - protein, 193 aa, Homo sapiens; identical to SEQ ID NO: 895043

SEQ ID NO: 895050 - protein, 175 aa, Homo sapiens
MIQAILVFNNHGKPRLVRFYQRFPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVIKVPNLSQFV

SEQ ID NO: 895051 - protein, 146 aa, Homo sapiens
MFPIFCSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 895052 - protein, 185 aa, Homo sapiens
MSSVLILDCLLPHPCLAASNFLKSHLSPIREMLAIFHGQLHIQWTRSELTSRTNTGSCSLIHCSLTLESFCLPKNPVCPGHQARCFTHIYLIQSSLQSWKEAEDTLKVHYILQEVVMGGMVLETNMNEIVAQIEAQNRLEKSEGGLSAAPARAVSAVKNINLPEIPRNINIGDLNIKVPNLSQFV

SEQ ID NO: 895053 - protein, 226 aa, Homo sapiens
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWDD

SEQ ID NO: 895054 - protein, 226 aa, Homo sapiens; identical to SEQ ID NO: 895053

SEQ ID NO: 895055 - protein, 280 aa, Homo sapiens
SRVPARPAALPAPRPQPSAPALCRGARAVGRMSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWVGTWCWCSCISWQEHGTYWLRLWVG

SEQ ID NO: 895056 - protein, 85 aa, Homo sapiens
MIQAILVFNNHGKPRLVRFYQRFPEEIQQQIVRETFHLVLKRDDNICNFLEGGRFDLVALYYKLINPHYTTPLLFIFVWRLKVNI

SEQ ID NO: 895057 - protein, 519 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 895058 - protein, 232 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGGLYPKGSKKKGFGGGGF

SEQ ID NO: 895059 - protein, 73 aa, Homo sapiens
FVIQFQLPRAVNTQALSGAGILRMVNKAADAVNKMTIKMNESDAWFEEKQQQFENLDQQLRMLLDVKKHPELT

SEQ ID NO: 895060 - protein, 519 aa, Homo sapiens; identical to SEQ ID NO: 895057

SEQ ID NO: 895061 - protein, 519 aa, Homo sapiens; identical to SEQ ID NO: 895057

SEQ ID NO: 895062 - protein, 509 aa, Homo sapiens [sequence omitted]

SEQ ID NO: 895063 - protein, 418 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWLPEW

SEQ ID NO: 895064 - protein, 398 aa, Homo sapiens
MMTEKIFLQIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 895065 - protein, 311 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAVRADFSA

SEQ ID NO: 895066 - protein, 241 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALER

SEQ ID NO: 895067 - protein, 223 aa, Homo sapiens
CTPREPRPWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 895068 - protein, 168 aa, Homo sapiens
DFYMFSELLSDYIRLIAAVKGVFDHQNQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 895069 - protein, 670 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 895070 - protein, 541 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSGVGG

SEQ ID NO: 895071 - protein, 666 aa, Homo sapiens
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 895072 - protein, 670 aa, Homo sapiens; identical to SEQ ID NO: 895069

SEQ ID NO: 895073 - protein, 683 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPVGHSLWALPSFFTPAPWPACRRHLRAMQIPGCGLRHCRNCF

SEQ ID NO: 895074 - protein, 587 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQLRAHLRCGEGLLGGRAPAGQLHLRPGGLCAHPAPLPAP

SEQ ID NO: 895075 - protein, 566 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTSTCTFTMWRRTAGRKGPSWTTPSQAWRPVCSPCPAPCSLSRPAGPLTAARPTRTLPLR

SEQ ID NO: 895076 - protein, 371 aa, Homo sapiens
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYFRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 895077 - protein, 334 aa, Homo sapiens
PTTHWKSDRSSVCGLCRLGCRLSFRWYMRALATVSLKGLGSSYVMQPLQDLSFHQRKPALSKDFEQSPDAGYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 895078 - protein, 575 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQQVSGARGSPHPSSFPSLSVVIDGKCN

SEQ ID NO: 895079 - protein, 516 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTLGLEDESS

SEQ ID NO: 895080 - protein, 177 aa, Homo sapiens
LAHGQDVSTLALCHPSRGPDLSEWWVTVATLVSGLVGELAASSQWVLGFILALALQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 895081 - protein, 508 aa, Homo sapiens
RLAPPASRLPPPSSCECGLGWRRHQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKRELGKQQFSSLATEGQPWLSTSCIVAAGVPSCTHSFRNY

SEQ ID NO: 895082 - protein, 180 aa, Homo sapiens
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQVRHVSSSKADPHPGGVP

SEQ ID NO: 895083 - protein, 501 aa, Homo sapiens
MATSFRTASCWGLLSFKDISMEFTWDEWQLLDSTQKYLYRDVILENYHNLISVDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 895084 - protein, 533 aa, Homo sapiens
MATSFRTASCWGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 895085 - protein, 513 aa, Homo sapiens
MEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 895086 - protein, 85 aa, Homo sapiens
ESGQRVYLAESLWPRRRGAKRLGLSWADQRLDQLNTSVGPGRGRGQISLLLSRVRATERHKSIRATPGTQTGRLSSHARSVLGES

SEQ ID NO: 895087 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 895088 - protein, 72 aa, Homo sapiens
DKGESPVEPAGSLVFTLAGALFLHQRRKYRSNKGESPVEPAEPCRYSCPREEEGSTIPIQEDYRKPEPACSP

SEQ ID NO: 895089 - protein, 319 aa, Homo sapiens
LIPKKKGFLGGFFGPKPLWKKQPLPRGCKEETAAPSLEVLTPEASISNWAQKGAAWAGTMARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 895090 - protein, 358 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSTGVLLTPLPQAHPPLPISFSRLPLPPLLAKTHRISFCRQRRKSCGACRALSLQLPQGGGGQHHPHPGGLPKTGACLLPLSQHLRELHYSPGLHPHPADHPRESETWQPQLQSHPLVRALSCVHVTECLFETGRDEDKYG

SEQ ID NO: 895091 - protein, 126 aa, Homo sapiens
EARGAAQDSRMYTLLSGLYKYMFQKDEYCILILGLDNAGKTTFLEQSKTRFNKNYKGMSLSKITTTVGLNIGTVDVGKARLMFWDLGGQEELQSLWDKSGQDKVWGPGDPALLQSECLLSAQRPCC

SEQ ID NO: 895092 - protein, 201 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 895093 - protein, 201 aa, Homo sapiens; identical to SEQ ID NO: 895092

SEQ ID NO: 895094 - protein, 201 aa, Homo sapiens; identical to SEQ ID NO: 895092

SEQ ID NO: 895095 - protein, 228 aa, Homo sapiens
TTTNTQNNYGQVRGCVGYSSGSEGAAEMYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 895096 - protein, 154 aa, Homo sapiens
MSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 895097 - protein, 201 aa, Homo sapiens; identical to SEQ ID NO: 895092

SEQ ID NO: 895098 - protein, 154 aa, Homo sapiens; identical to SEQ ID NO: 895096

SEQ ID NO: 895099 - protein, 218 aa, Homo sapiens
MYTLLSGLYKYMFQKDEYCILILGLDNAGKTWELGKDDQLMNNEEPLVEQEIYHMNNRMQGQGTSISLINSQDSQVYLGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 895100 - protein, 121 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFDVPLNP

SEQ ID NO: 895101 - protein, 173 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTG

SEQ ID NO: 895102 - protein, 201 aa, Homo sapiens; identical to SEQ ID NO: 895092

SEQ ID NO: 895103 - protein, 173 aa, Homo sapiens; identical to SEQ ID NO: 895101

SEQ ID NO: 895104 - protein, 163 aa, Homo sapiens [sequence omitted]

SEQ ID NO: 895105 - protein, 299 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIQRGARGHRVDGEVCRAECAPAAAAEGHHVGAAALPSGRLVPWCWRSGLLLAPMLLIWGVGLLCFGVLLFTLFSRRQTFLYVWKSVGIRRLWRGVWQPGWPRPCSGSLSTGRSGGLSRPFLGGLRETWLGIGAPVLRLAWAA

SEQ ID NO: 895106 - protein, 116 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKSGQDKVWGPGDPALLQSECLLSAQRPCC

SEQ ID NO: 895107 - protein, 731 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 895108 - protein, 731 aa, Homo sapiens; identical to SEQ ID NO: 895107

SEQ ID NO: 895109 - protein, 711 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 895110 - protein, 694 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 895111 - protein, 684 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFR

SEQ ID NO: 895112 - protein, 268 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEGRGLNCSGLGI

SEQ ID NO: 895113 - protein, 731 aa, Homo sapiens; identical to SEQ ID NO: 895107

SEQ ID NO: 895114 - protein, 711 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELESTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 895115 - protein, 718 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGIRLGIFLRRYPIARVFVIIYMALLHLWVMIVLLTYTPEMHHDQPYGK

SEQ ID NO: 895116 - protein, 115 aa, Homo sapiens
MLESLSTEKNSLVFQLERLEQQMNSASGSSSNGSSINMSGIDNGEGTRLRNVPVLFNDTETNLAGMYGIRLGIFLRRYPIARVFVIIYMALLHLWVMIVLLTYTPEMHHDQPYGK

SEQ ID NO: 895117 - protein, 201 aa, Homo sapiens
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWV

SEQ ID NO: 895118 - protein, 143 aa, Homo sapiens
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQFWCLWFCYDKCFWN

SEQ ID NO: 895119 - protein, 485 aa, Homo sapiens
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895120 - protein, 485 aa, Homo sapiens; identical to SEQ ID NO: 895119

SEQ ID NO: 895121 - protein, 485 aa, Homo sapiens; identical to SEQ ID NO: 895119

SEQ ID NO: 895122 - protein, 485 aa, Homo sapiens; identical to SEQ ID NO: 895119

SEQ ID NO: 895123 - protein, 485 aa, Homo sapiens; identical to SEQ ID NO: 895119

SEQ ID NO: 895124 - protein, 323 aa, Homo sapiens
MLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895125 - protein, 205 aa, Homo sapiens
MDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895126 - protein, 205 aa, Homo sapiens; identical to SEQ ID NO: 895125

SEQ ID NO: 895127 - protein, 304 aa, Homo sapiens
ETSVAQSPRLEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895128 - protein, 154 aa, Homo sapiens
MGSSATDFLALTPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895129 - protein, 168 aa, Homo sapiens
MLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGHDVTMQGTRGLV

SEQ ID NO: 895130 - protein, 162 aa, Homo sapiens
MLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEGHDVTMQGTRGLV

SEQ ID NO: 895131 - protein, 386 aa, Homo sapiens
MEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895132 - protein, 340 aa, Homo sapiens
MPNNATAMLSKKSPIIPECSTNVQTAAGGSNSSQYNSNLTIRLSVSWKGQSKSTVGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895133 - protein, 323 aa, Homo sapiens; identical to SEQ ID NO: 895124

SEQ ID NO: 895134 - protein, 323 aa, Homo sapiens; identical to SEQ ID NO: 895124

SEQ ID NO: 895135 - protein, 485 aa, Homo sapiens; identical to SEQ ID NO: 895119

SEQ ID NO: 895136 - protein, 322 aa, Homo sapiens
MPNNATAMLSKKSPIIPECSTNVQTAAGGSNSSQYNSNLTIRLSVSWKGQSKSTVGTVFSLESEEEEYPGITAEDSNDIYILPSDNSGQVSPPESPTVTTSWQSESLPVSLSASQSWHTESLPVSLGPESWQQIAMDPEEVSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 895137 - protein, 201 aa, Homo sapiens; identical to SEQ ID NO: 895117

SEQ ID NO: 895138 - protein, 168 aa, Homo sapiens; identical to SEQ ID NO: 895129

SEQ ID NO: 895139 - protein, 68 aa, Homo sapiens
MSSGASASALQRLVEQLKLEAGVERIKVSQAAAELQQYCMQNACKDALLVGVPAGSNPFREPRSCALL

SEQ ID NO: 895140 - protein, 68 aa, Homo sapiens; identical to SEQ ID NO: 895139

SEQ ID NO: 895141 - protein, 161 aa, Homo sapiens
AEPPARLGMGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 895142 - protein, 68 aa, Homo sapiens; identical to SEQ ID NO: 895139

SEQ ID NO: 895143 - protein, 143 aa, Homo sapiens
AEPPARLGMGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKSSCICPRGLGVEWTPAEAPQLFL

SEQ ID NO: 895144 - protein, 143 aa, Homo sapiens; identical to SEQ ID NO: 895143

SEQ ID NO: 895145 - protein, 68 aa, Homo sapiens; identical to SEQ ID NO: 895139

SEQ ID NO: 895146 - protein, 68 aa, Homo sapiens; identical to SEQ ID NO: 895139

SEQ ID NO: 895147 - protein, 249 aa, Homo sapiens
RGGGGAWARRAPAGSLQVLGPGTLPGDTAMAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 895148 - protein, 249 aa, Homo sapiens; identical to SEQ ID NO: 895147

SEQ ID NO: 895149 - protein, 249 aa, Homo sapiens; identical to SEQ ID NO: 895147

SEQ ID NO: 895150 - protein, 242 aa, Homo sapiens
RGGGGAWARRAPAGSLQVLGPGTLPGDTAMAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVKQTVVNLATLMKFLKVAHTHLKGLMFLWKASQNISQFSVTCWFVCLLVYLLVYQ

SEQ ID NO: 895151 - protein, 284 aa, Homo sapiens
RGGGGAWARRAPAGSLQVLGPGTLPGDTAMAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVHWKTSCGDHLVQLLHCIAEDTQAQRGEVIWSKSHSK

SEQ ID NO: 895152 - protein, 227 aa, Homo sapiens
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQSTYTSFT

SEQ ID NO: 895153 - protein, 249 aa, Homo sapiens; identical to SEQ ID NO: 895147

SEQ ID NO: 895154 - protein, 249 aa, Homo sapiens; identical to SEQ ID NO: 895147

SEQ ID NO: 895155 - protein, 249 aa, Homo sapiens; identical to SEQ ID NO: 895147

SEQ ID NO: 895156 - protein, 313 aa, Homo sapiens
RGGGGAWARRAPAGSLQVLGPGTLPGDTAMAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVHIFLNSISVRNGILRWPPRLTRHGTIFVIVRRTCEYDELSLLCFCGFMWQRESVLGGPDLIRHIL

SEQ ID NO: 895157 - protein, 103 aa, Homo sapiens [sequence omitted]

SEQ ID NO: 895158 - protein, 1540 aa, Homo sapiens
GVCSGPVIVHVPGGRPLRAAVPTHSWRVSSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 895159 - protein, 1475 aa, Homo sapiens
GVCSGPVIVHVPGGRPLRAAVPTHSWRVSSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 895160 - protein, 1412 aa, Homo sapiens
MLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 895161 - protein, 1412 aa, Homo sapiens; identical to SEQ ID NO: 895160

SEQ ID NO: 895162 - protein, 1186 aa, Homo sapiens
MLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKW

SEQ ID NO: 895163 - protein, 856 aa, Homo sapiens
GVCSGPVIVHVPGGRPLRAAVPTHSWRVSSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKGRTSSHRLRGNREQESKSITDFYLGP

SEQ ID NO: 895164 - protein, 471 aa, Homo sapiens [sequence omitted]

SEQ ID NO: 895165 - protein, 1418 aa, Homo sapiens
MLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQAGPESTGRE

SEQ ID NO: 895166 - protein, 132 aa, Homo sapiens
IEDFRTWFIDLEIGNDRVVPQVNEPGPEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 895167 - protein, 75 aa, Homo sapiens
GVCSGPVIVHVPGGRPLRAAVPTHSWRVSSKLSHISRLELVESLDSDEVDLKSGYMSDSDLMGKTMTEDDDITTG

SEQ ID NO: 895168 - protein, 163 aa, Homo sapiens
LEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGPRVPEKEDSAECPGSPAEPGRDHVL

SEQ ID NO: 895169 - protein, 1412 aa, Homo sapiens; identical to SEQ ID NO: 895160

SEQ ID NO: 895170 - protein, 1507 aa, Homo sapiens
GCQARAVLGGAGCPPGEWPPEPGKMLHLPLPRSGRTVNFPRSWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 895171 - protein, 845 aa, Homo sapiens
MGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 895172 - protein, 1271 aa, Homo sapiens
MEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGTGVQLPPGVRRWLPFSTVPPGGMLPSLPGVFGM

SEQ ID NO: 895173 - protein, 1412 aa, Homo sapiens; identical to SEQ ID NO: 895160

SEQ ID NO: 895174 - protein, 1271 aa, Homo sapiens; identical to SEQ ID NO: 895172

SEQ ID NO: 895175 - protein, 780 aa, Homo sapiens
MLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWVGKGLGGGEVGRTVVDRLHLSIGIESFQD

SEQ ID NO: 895176 - protein, 512 aa, Homo sapiens
GVCSGPVIVHVPGGRPLRAAVPTHSWRVSSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPD

SEQ ID NO: 895177 - protein, 1055 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 895178 - protein, 1055 aa, Homo sapiens; identical to SEQ ID NO: 895177

SEQ ID NO: 895179 - protein, 450 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 895180 - protein, 343 aa, Homo sapiens
PRAVYAMQSVYVILRHGFQTQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 895181 - protein, 653 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRELASISSPEKCNRFT

SEQ ID NO: 895182 - protein, 1087 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSIMMTPNMQGIIMAIGKSRSVYDRCGPEAGFFKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 895183 - protein, 1055 aa, Homo sapiens; identical to SEQ ID NO: 895177

SEQ ID NO: 895184 - protein, 287 aa, Homo sapiens
QPVACDNHYQKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 895185 - protein, 99 aa, Homo sapiens
ALADSGVANMSTAMNFGTKSFQPRPPDKGSFPLDHLGECKSFKEKFMKCLHNNNFENALCRKESKEYLECRMERKLMLQEPLEKLGFGDLTSGKSEAKK

SEQ ID NO: 895186 - protein, 99 aa, Homo sapiens; identical to SEQ ID NO: 895185

SEQ ID NO: 895187 - protein, 321 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 895188 - protein, 199 aa, Homo sapiens
MAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 895189 - protein, 340 aa, Homo sapiens [sequence omitted]

SEQ ID NO: 895190 - protein, 199 aa, Homo sapiens; identical to SEQ ID NO: 895188

SEQ ID NO: 895191 - protein, 199 aa, Homo sapiens; identical to SEQ ID NO: 895188

SEQ ID NO: 895192 - protein, 199 aa, Homo sapiens; identical to SEQ ID NO: 895188

SEQ ID NO: 895193 - protein, 321 aa, Homo sapiens; identical to SEQ ID NO: 895187

SEQ ID NO: 895194 - protein, 304 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSSLSCC

SEQ ID NO: 895195 - protein, 343 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVSWPWGQVANGKGNQRNMGSPQPSLLAFERNLELQIMGLGYSLLMGKLRPRVAKDTLRVHRDSTPSPLTLKD

SEQ ID NO: 895196 - protein, 1070 aa, Homo sapiens
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEVRKGGALREERPGAAGGGASAPGSPEEAARGAGPRPNMFDVLTFPGTGKAPFGSPAADAPPPAVAAAEVPGSEGGSATGESACHFEGQQRLRGAHAEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 895197 - protein, 973 aa, Homo sapiens
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 895198 - protein, 973 aa, Homo sapiens; identical to SEQ ID NO: 895197

SEQ ID NO: 895199 - protein, 1204 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 895200 - protein, 1204 aa, Homo sapiens; identical to SEQ ID NO: 895199

SEQ ID NO: 895201 - protein, 827 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLR

SEQ ID NO: 895202 - protein, 827 aa, Homo sapiens; identical to SEQ ID NO: 895201

SEQ ID NO: 895203 - protein, 1235 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEVINEVEKAPKELRKELMKRRKEELAQSQHAQEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 895204 - protein, 294 aa, Homo sapiens
VSNADPGESRAAQSQHAQEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 895205 - protein, 1204 aa, Homo sapiens; identical to SEQ ID NO: 895199

SEQ ID NO: 895206 - protein, 1204 aa, Homo sapiens; identical to SEQ ID NO: 895199

SEQ ID NO: 895207 - protein, 1204 aa, Homo sapiens; identical to SEQ ID NO: 895199

SEQ ID NO: 895208 - protein, 827 aa, Homo sapiens; identical to SEQ ID NO: 895201

SEQ ID NO: 895209 - protein, 181 aa, Homo sapiens
EQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQVSVHESLFGFSFAIF

SEQ ID NO: 895210 - protein, 111 aa, Homo sapiens
MECAHSSLLTKSMLFSACRDKNMVNSRHKAQALSWARNPSLLGWLSPGEGTLATHPGSEPRTPHHCLIEGSLAPGGQRLLPSPSLFSPLPGLVATQPDSISNTPLPPGMAV

SEQ ID NO: 895211 - protein, 58 aa, Homo sapiens
MDTQKDVQPPKQQPMIYICGECHTENEIKSRDPIRCRECGYRIMYKKRTKRLVVFDAR

SEQ ID NO: 895212 - protein, 58 aa, Homo sapiens; identical to SEQ ID NO: 895211

SEQ ID NO: 895213 - protein, 58 aa, Homo sapiens; identical to SEQ ID NO: 895211

SEQ ID NO: 895214 - protein, 58 aa, Homo sapiens; identical to SEQ ID NO: 895211

SEQ ID NO: 895215 - protein, 58 aa, Homo sapiens; identical to SEQ ID NO: 895211

SEQ ID NO: 895216 - protein, 58 aa, Homo sapiens; identical to SEQ ID NO: 895211

SEQ ID NO: 895217 - protein, 81 aa, Homo sapiens
RDAKVVGIRGSSGCLRSVSGASGGGGLGRRDGWCAGTLMLKYYEPSELVERLQSFGCYGPFSWAHTFGVVQNQKQPCFPNT

SEQ ID NO: 895218 - protein, 570 aa, Homo sapiens
MSRLEAKKPSLCKSEPLTTERVRTTLSVLKRIVTSCYGPSGRLKQLHNGFGGYVCTTSQSSALLSHLLVTHPILKILTASIQNHVSSFSDCGLFTAILCCNLIENVQRLGLTPTTVIRLNKHLLSLCISYLKSETCGCRIPVDFSSTQILLCLVRSILTSKPACMLTRKETEHVSALILRAFLLTIPENAEGHIILGKSLIVPLKGQRVIDSTVLPGILIEMSEVQLMRLLPIKKSTALKVALFCTTLSGDTSDTGEGTVVVSYGVSLENAVLDQLLNLGRQLISDHVDLVLCQKVIHPSLKQFLNMHRIIAIDRIGVTLMEPLTKMTGTQPIGSLGSICPNSYGSVKDVCTAKFGSKHFFHLIPNEATICSLLLCNRNDTAWDELKLTCQTALHVLQLTLKEPWALLGGGCTETHLAAYIRHKTHNDPESILKDDECTQTELQLIAEAFCSALESVVGSLEHDGGEILTDMKYGHLWSVQADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 895219 - protein, 570 aa, Homo sapiens; identical to SEQ ID NO: 895218

SEQ ID NO: 895220 - protein, 81 aa, Homo sapiens; identical to SEQ ID NO: 895217

SEQ ID NO: 895221 - protein, 570 aa, Homo sapiens; identical to SEQ ID NO: 895218

SEQ ID NO: 895222 - protein, 570 aa, Homo sapiens; identical to SEQ ID NO: 895218

SEQ ID NO: 895223 - protein, 81 aa, Homo sapiens; identical to SEQ ID NO: 895217

SEQ ID NO: 895224 - protein, 106 aa, Homo sapiens
TDTIEPVPDEESGQFKAADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 895225 - protein, 1412 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKKHPQTSSSGDPCQDGIFISGQQNYSSATLSHKDVPPDSLMKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 895226 - protein, 1371 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 895227 - protein, 1371 aa, Homo sapiens; identical to SEQ ID NO: 895226

SEQ ID NO: 895228 - protein, 1371 aa, Homo sapiens; identical to SEQ ID NO: 895226

SEQ ID NO: 895229 - protein, 1371 aa, Homo sapiens; identical to SEQ ID NO: 895226

SEQ ID NO: 895230 - protein, 1371 aa, Homo sapiens; identical to SEQ ID NO: 895226

SEQ ID NO: 895231 - protein, 1124 aa, Homo sapiens
MSHTDCWWTCFYFKLKNCMLFLPSLGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 895232 - protein, 1371 aa, Homo sapiens; identical to SEQ ID NO: 895226

SEQ ID NO: 895233 - protein, 1412 aa, Homo sapiens; identical to SEQ ID NO: 895225

SEQ ID NO: 895234 - protein, 1322 aa, Homo sapiens [sequence omitted]

SEQ ID NO: 895235 - protein, 1371 aa, Homo sapiens; identical to SEQ ID NO: 895226

SEQ ID NO: 895236 - protein, 1322 aa, Homo sapiens [sequence omitted]

SEQ ID NO: 895237 - protein, 635 aa, Homo sapiens
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKG

SEQ ID NO: 895238 - protein, 367 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 895239 - protein, 135 aa, Homo sapiens
ARPCDAGRERAAAPEPPSFLPLIPGCHGDPQQSDPHQLQLVAHLRAGERCGQASGGPRRSRGGQPRPLAQGEPGSVPLDPVLQLAEGAAGDRREGPGVRGAGREPATERAQGALVHAAQPGRGGARHHPPRQHHQ

SEQ ID NO: 895240 - protein, 135 aa, Homo sapiens
MATPNNLTPPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQLPRKLGRQPIGL

SEQ ID NO: 895241 - protein, 304 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGGCQPWGRWGLQPTQPTLPLPSLSLFFPQKSQRTSQVVKRMGYGVRLRFKS

SEQ ID NO: 895242 - protein, 343 aa, Homo sapiens
PCREPDTEGWRLFWRGPGGGGERSSRDPLAPSPNCPVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 895243 - protein, 449 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGPRLAASLELRGANPRGQLGRAQLRRDGRATTRIPCPPAAKPEHGGAQGLWAETSWGSGMPGAGGRGRCPSGFPAQPLAVPTEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 895244 - protein, 309 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGGHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 895245 - protein, 1299 aa, Homo sapiens
MEYAERDGSVQLFCRLQFSQGQIERGKFKQGALEVDNQSSILRTDGFREHELYVPWQNAMVNIRNCEIELTEVENENTKNVKFGGYVLDHFYWSSNNDHCLPDYCKILVGSLRIDSWLGLWRLWHAVSRRESVKQFLMKKFKNYTKLEVVHWYSTSRSDTYHYSYHVCFICHFFVCLSILKSHTLCYFTAVNTLGRYHDITPNRGSSSPSASSHSQSLRNFPDYLKNHLLVGLLESTEYKSHDDFVFNNAPQMTLMLATLRTTGNYFANLKVQVRIPQFLARLVDYKCDFEILEEAFGVNDRICIYISKFDKIKFPQERRISAPWALIDWDLCRAWSQFNPTGLYAVVSLMLWLIYTVTHTTLWISWKVLHLVYLDLTYIDHFTIKLNYSENCLLGDCFYLKLKVSQNMYNNFYMNFLNLSLDKVILLNSKEMQFLELMRGEIIDGQLRERIPSSYKWSFIKHSVSMQFNKLHDLLFESMYSDLRTISGLQYYQSGMPLKCSQTSFVRSRKELGKPLKIYIVIYALRKCILFSNEEWFIIYKGFKALKYHQCLLIALSSCLQSDVIGIVKRRPDFELDLDSLFSNSGMLFNLLCAFRFLSTISVPFKPHKMKLRRDNGFGSILRGLYYATPVLLLKFCFVLLFSVQSVQFTQAECFLTYISSYEFVYVRKSFSGRESREEKNDVTNQKRRKREEVRKGVRKEKGVRMGMAKGRVREKMEGVYGKLRSRDGEKWCGNIYFLVVALTLHQFACLGSLGSGKVLTSMEWGSRACCIWFVSTRVVSQSPYSLIISVPIQHFMSFFFSGSQFVSRTCGNTSIFLFNFIVLAIPSVRLQDKLHIPQWRLEVEGTASLGLKGAKECVAAVFADDTDERPGLGITALPWMANYAINYTYLFLSWDTFSGTILSRFKRTKDSRNTLKDIIGCLIFQIFVFNKYLSSSQNLFEMFLERPLICFLKYFFGSLEYRRKVGVQYVRCGASYPFIKCNFKCLKNNNVPYCILIFNKVELNKDLYYNSYSFIHCQSNPFLPIKIWLNCSDVVSYFIKHETRFYKLNYKRQKSKNGTRKFFFKKLMCYSNIQQLKTHEKNRIAIRCNSLKWIANQCQTLIENIYYHLISTNNFRCLMGLGKDRKKYEMKIYLTFNTVNTIWRVPGQTFEISNLRTDMEPLISLYTGSEYLHTYAHYSNLLLKIMKIEFNSVYSIKKLIGWVWWLMHVIPALWEAEAGGSLEPKEFETSLGDKVRPHLYKKIKKLSRCGGVCLLVLATQEVEAGGLLECKSLRLQRAKIAPLHSSLGDRARPCLKK

SEQ ID NO: 895246 - protein, 1300 aa, Homo sapiens
MEYAERDGYVQLFCRLQFSQGQIERGKFKQGALEVDNQSSILRTDGFREHELYVPWQNAMVNIRNCEIELTEVENENTKNVKFGGYVLDHFYWSSNNDHCLPDYCKILVGSLRIDSWLGLWRLWHAVSRRESVKQFLMKKFKNYTKLEVVHWYSTSRSDTYHYSYHVCFICHFFVCLSILKSHTLCYFTAVNTLGRYHDITPNRGSSSPSASSHSQSLRNFPDYLKNHLLVGLLESTEYKSHDDFVFNKSPQMTLMLATLRTTGNYFANLKVQVRIPQFLARLVDYKCDFEILEEAFGVNDRIRIYISKFDKKNFLSERRISAPWALIDWDLCRAWSQFNPTGLYAVVSLMLWLIYTVTHTTLWISWKVLHLVYLDLTYIDHFTIKLNYSENCLLGDCFYLKLKVSQNMYNNFEMNFLNLSLDKVILLNSKEMQFLELMRGEIIDGQLRERIPSSYKWSFIKHSVSMQFNKLHDLLFESMYSDLRTISGLQYYQSGMPLKCSQTSFVRSRKELGKPLKIYIVIYALRKCILFSNEEWFIIYKGFEGPEITLVLTHCSLILLQSDVIGIVKRRPDFELDLDSLFSNSGMLFNLLCAFRFLSTISVPFKPHKMKLRRDNGFGSILRGLYYATPVLLLKFCFVLLFSVQSVQFTQAECFLTYISSDEFVYVRKSFSGRESREEKNDVTNQKKKEKRGSEKRGEERERSKNGDGKGQSKRKDGMSVWKIEKYEMERNGVETFTFSVVALTLHQFACLGSLGSGKVLTSMEWGSRACCIWFVSTRVVSQSPYSLIISVPIQHFMSFFFSGSQFVSRTCGNTSIFLFNFIVLAIPSVRLQDKLHIPQWRLEVEGTASLGLKGAKECVAAVFADDTDERPGLGITALPWMANYAINYTYLFLSWDTFSGTILSRFKRTKDSRNTLKDIIGCLIFQIFVFNKYLSSSQNLFEMFLERPLICFLKEFFWFLRVEKKSRGAMMSGVGPVIHLLNAISSVLKTIIALCILIFNKVELNKDLYYNSYSFIHCQSNPFLPIKIWLNCSDVVSYFIKHETRFYKLNYKRQKSKNGTRKFFFKKLMCYSNIQQLKTHEKNRIAYWMSQFKMDCKSMSDLNRKYLLSPHFYQSFQMFNGTLKREEKIEMKIYLTFNTVNTIWRVPGQTFEISNLRTDMEPLISLYTGSEYLHNIAHYSNLLLKIMKIEFNSVYSIKKLIGWVWWLMHVIPALWEAEAGGSLEPKEFETSLGDKVRPHLYKKIKKLSRCGGVCLLVLATQEVEAGGLLECKSLRLQRAKIAPLHSSLGDRARPCLKK

SEQ ID NO: 895247 - protein, 1297 aa, Homo sapiens
MEYAERDGSVQLFCRLQFSQGQIERGKFKQGALEVDNQSSILRTDGFREHELYVPWQNAMVNIRNCEIELTEVENENTKNVKFGGYVLDHFYWSSNNDHCLPDYCKILVGSLRIDSWLGLWRLWHAVSRRESVKQFLMKKFKNYTKLEVVHWYSTSRSDTYHYSYHVCFICHFFVCLSILKSHTLCYFTAVNTLGRYHDITPNRGSSSPSASSHSQSLRNFPDYLKNHLLVGLLESTEYKSHDDFVFNNAPQMTLMLATLRTTGNYFANLKVQVRIPQFLARLVDYKCDFEILEEAFGVNDRICIYISKFDKIKFPQERRISAPWALIDWDLCRAWSQFNPTGLYAVVSLMLWLIYTVTHTTLWISWKVLHLVYLDLTYIDHFTIKLNYSENCLLGDCFYLKLKVSQNMYNNFYMNFLNLSLDKVILLNSKEMQFLELMRGEIIDGQLRERIPSSYKWSFIKHSVSMQFNKLHDLLFESMYSDLRTISGLQYYQSGMPLKCSQTSFVRSRKELGKPLKIYIVIYALRKCILFSNEEWFIIYKGFKALKYHQCLLIALSSCLQSDVIGIVKRRPDFELDLDSLFSNSGMLFNLLCAFRFLSTISVPFKPHKMKLRRDNGFGSILRGLYYATPVLLLKFCFVLLFSVQSVQFTQAECFLTYISSYEFVYVRKSFSGRESREEKNDVTNQKRRKREEVRKGVRKEKGVRMGMAKGRVREKMEGVYGKLRSRDGEKWCGNIYFLVVALTLHQFACLGSLGSGKVLTSMEWGSRACCIWFVSTRVVSQSPYSLIISVPIQHFMSFFFSGSQFVSRTCGNTSIFLFNFIVLAIPSVRLQDKLHIPQWRLEVEGTASLGLKGAKECVAAVFADDTDERPGLGITALPWMANYAINYTYLFLSWDTFSGTILSRFKRTKDSRNTLKDIIGCLIFQIFVFNKYLSSSQNLFEMFLERPLICFLKYFFGSLEYRRKVGVQYVRCGASYPFIKCNFKCLKNNNVPYCILIFNKVELNKDLYYNSYSFIHCQSNPFLPIKIWLNCSDVVSYFIKHETRFYKLNYKRQKSKNGTRKFFFKKLMCYSNIQQLKTHEKNRIAIRCNSLKWIANQCQTLIENIYYHLISTNNFRCLMGLGKDRKKYEMKIYLTFNTVNTIWRVPGQTFEISNLRTDMEPLISLYTGSEYLHTYAHYSNLLLKIMKIEFNSVYSIKKLIGWVWWLMHVIPALWEAEAGGSLEPKEFETSLGDKVRPHLYKKIKRQEDCLSARVRGCREPRLHHCTPAWVTERDPVSKIKEIGFDYEKQPFSTFL

SEQ ID NO: 895248 - protein, 1032 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895249 - protein, 139 aa, Homo sapiens
SPRPAPPRPFRLSTGLVVQFGRRITYMEEVKEEVKKFNMRSVKGGGGNEKKSGPTVTKVVTVVTTKKAVVDSDKKKGELMENDQDAMEYFFMRRKKKVMVEEEDGDEDEEAESATGKRAAEDDEDDDVDTKKQKTDEDD

SEQ ID NO: 895250 - protein, 981 aa, Homo sapiens
GKYKAVELNALYFRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895251 - protein, 997 aa, Homo sapiens
GKYKAVELNALYFRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGPSRFIELGFRDLNIKGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895252 - protein, 873 aa, Homo sapiens
MRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895253 - protein, 243 aa, Homo sapiens
GKYKAVELNALYFRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMER

SEQ ID NO: 895254 - protein, 790 aa, Homo sapiens
EIIQLESGVGVEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895255 - protein, 758 aa, Homo sapiens
KAEVDNYYYGDKGCRCALEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895256 - protein, 293 aa, Homo sapiens
GKYKAVELNALYFRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYFFMRRKKKVMVEEEDGDEDEEAESATGKRAAEDDEDDDVDTKKQKTDEDD

SEQ ID NO: 895257 - protein, 241 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAKRGKRGDDSRS

SEQ ID NO: 895258 - protein, 455 aa, Homo sapiens
IGSQGVEIVEYSGLSAVEAEIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895259 - protein, 407 aa, Homo sapiens
GKYKAVELNALYFRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKWREEQRKKAMENIGELKKEIEEMKQGKKWSLEDDDDDEDDPAEAEKEGNEMEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIGTILFIKLFFK

SEQ ID NO: 895260 - protein, 813 aa, Homo sapiens
MEGEELDPLDAYMEEVKEEVKKFNMRSVKGGGGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895261 - protein, 686 aa, Homo sapiens
VPCSLVTAVVWYSDKVKGKGCPKPIKSWVQCGISMKILNSLKKHGYEKPTPIQTQAIPAIMSGRDLIGIAKTGSGKTIAFLLPMFRHIMDQRSLEEGEGPIAVIMTPTRELALQITKECKKFSKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895262 - protein, 251 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGNKSKKTENRSRSKEKTDGGESSKEKKKDKDDKEDEKEKDAGNFDQNKLEEEMRKRKERVEKKKKKLETSSLSARVKLLRGSAKTPPRCAKWPPHLVARLGGTSPPSARTPTILASGDRGEHDGPPGFVAMGHLGLLPGLDCAS

SEQ ID NO: 895263 - protein, 428 aa, Homo sapiens
LVSSASSLLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 895264 - protein, 1384 aa, Homo sapiens
MKDLDGMDADILGLKKSNSAPSKKAAKDPGKGELPNHPKPAGGAIPTKKSLPSPSSSGHQNRRFSSEDLEDPLGGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSLTWAFCHLHLERCLSSANLSPAHKGLSTQLLEGVLEQLHEERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQHLRSAVAPGSWTTARRRVLLALLQTCRNCGPGRLNNLPEMTAVLGRRTPPLGPMPNSDIDLSNLERLEKYRSFDRYRRRAEQEAQAPHWWRTYREYFGEKTDPKEKIDIGLPPPKVSRTQQLLERKQAIQELRANVEEERAARLRTVSLLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVR

SEQ ID NO: 895265 - protein, 1124 aa, Homo sapiens
MTLPEKPVKLASHTRDTTGVSQMFPSSKARTKSLLGDDVFSTMAGLEEADAEVSVISEADPQALLQAMKDLDGMDADILGLKKSNSAPSKKAAKDPGKGELPNHPKPAGGAIPTKKSLPSPSSSGHQNRRFSSEDLEDPLGGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 895266 - protein, 1151 aa, Homo sapiens
MAPKTKKGCKVTLPEKPVKLASHTRDTTGVSQMFPSSKARTKSLLGDDVFSTMAGLEEADAEVSVISEADPQALLQAMKDLDGMDADILGLKKSNSAPSKKAAKDPGKGELPNHPKPAGGAIPTKKSLPSPSSSGHQNRRFSSEDLEDPLGGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSLTWAFCHLHLERCLSSANLSPAHKGLSTQLLEGVLEQLHEERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 895267 - protein, 982 aa, Homo sapiens
MAPKTKKGCKVTLPEKPVKLASHTRDTTGVSQMFPSSKARTKSLLGDDVFSTMAGLEEADAEVSVISEADPQALLQAMKDLDGMDADILGLKKSNSAPSKKAAKDPGKGELPNHPKPAGGAIPTKKSLPSPSSSGHQNRRFSSEDLEDPLGGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSLTWAFCHLHLERCLSSANLSPAHKGLSTQLLEGVLEQLHEERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKVGPRASGQWRAQGCLRPSIWTHPLPVLGKESVALMSQEHRD

SEQ ID NO: 895268 - protein, 243 aa, Homo sapiens
FGTRDEKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 895269 - protein, 117 aa, Homo sapiens
MTLPEKPVKLASHTRDTTGVSQMFPSSKARTKSLLGDDVFSTMAGLEEADAEVSVISEADPQALLQAMKDLDGMDADILGLKKSNSAPSKKAAKDPGKGELPNHPKPAGGSVASEKG

SEQ ID NO: 895270 - protein, 1134 aa, Homo sapiens
MAPKTKKGCKVTLPEKPVKLASHTRDTTGVSQMFPSSKARTKSLLGDDVFSTMAGLEEADAEVSVISEADPQALLQAMKDLDGMDADILGLKKSNSAPSKKAAKDPGKGELPNHPKPAGGAIPTKKSLPSPSSSGHQNRRFSSEDLEDPLGGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSQPLTSTQGLEHAAAGGSSGTTARERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQEHLSLAQQRLQLDRARQDLPSSLVGLFPRAQGPAASSQSALMPPAPTTRWCSQPPTGLDPSPLHLHARLALLRHMAEQDRDFLENEQFFLETLKKGSYNLTSHSA

SEQ ID NO: 895271 - protein, 1134 aa, Homo sapiens; identical to SEQ ID NO: 895270

SEQ ID NO: 895272 - protein, 1146 aa, Homo sapiens
MAPKTKKGCKVTLPEKPVKLASHTRDTTGVSQMFPSSKARTKSLLGDDVFSTMAGLEEADAEVSVISEADPQALLQAMKDLDGMDADILGLKKSNSAPSKKAAKDPGKGELPNHPKPAGGAIPTKKSLPSPSSSGHQNRRFSSEDLEDPLGGLLSYDEGGITKQPPVTQSKTASDKSPSTVRDQGPSIPLTPGDTPIRKKEELLFDDGDDIMATLGFGDSPKAEKRQIGDQEGPRPARSTLDELLGRGMATKLLARPGTGEHREFKLDKKYQRPQDSEDMWGDEDFTFGAYQPTVVSSEGRQSRRQSVSRFFADSGADPKGEPGSKQSPPMASSPIQPRKGGADWLGLKDEDLDLFPASPTREAHRESSVPVTPSVPPPASQHSTPAGLPPSRAKPPTEGAGSPAKASQASKLRASKEEKEDWLSHALSRKKSQGLAREQHAGTSEGLHLAGTAGHPPSGSLTWAFCHLHLERCLSSANLSPAHKGLSTQLLEGVLEQLHEERPCVRPGVSGSPVTQNHAASALPTGSPKRGTAPGDLSATEPATCFPSTQKPTEPSVPVQPLLPESLARSLLPSTEYQKQLLAAQVQLQCSPAELQAELLHSQARLAELEAQVRKLELERAQHELLLGSLQQQHQADLELIESAHRSRIKVLETSYQQREERLRRENEELSARYLSQCQEAEQARAELTAQHQRRLAAIAQEKDQEMERLRELQRASILDMRRDHEEQLQRLKLLKDREVDAATSATSHTRSLNSIIHQMEKFSSSLHELSSRVEASHLTTSQERELGIRQRDEQLRALQERLGQQQRDMEEERSRQQEVIGKMEARLNEQSRLLEQERWRVTAEQSKAESMQRALEEQRKVTAQQMAMERAELERAKSALLEEQKSVMLKCGEERRRLAAEWAEFSAQQKLSKERAEREAERALQVDTQREGTLISLAKEQAELKIRASELRAEEKQLAAERAALEQERQELRLEKERINATALRVKLRAEEVESMSKVASEKYEEGERALREAQQVQAEQQARLQAVQQQQERLRKQEQHMHQARLPECMAPLPPAPPASHLTAESFFLGERGQEHLSLAQQRLQLDRARQDLPSSLVGLFPRAQGPAASSQSGEWLQKEGPAAQDWAGAVLGVGRPSSSRSS

SEQ ID NO: 895273 - protein, 982 aa, Homo sapiens; identical to SEQ ID NO: 895267

SEQ ID NO: 895274 - protein, 103 aa, Homo sapiens
TQFCFLKASLPHLGSESQEVTEMGVVRAETHGMKIQKGLVQLFHSRCYGGPHLPEPGVCEGRDPVPRPTVGVCKPERTGLQIREESASCLAAEYWSQEPAMRF

SEQ ID NO: 895275 - protein, 102 aa, Homo sapiens
MFPGSLSRGRRAAVEMAWLPGSCARVAFAAGAAARYWTAWQGSAGPNPAAVAEAHGSLFCGRATSARAWSLRRPGPGSPAHSGGVQTRENWEVPSEAITDDV

SEQ ID NO: 895276 - protein, 115 aa, Homo sapiens
MAWLPGSCARVAFAAGAAARYWTAWQGSAGPNPAAVAEAHGSLFCGRATSARAWSLRRPGPGSPAHSGGVQTRENWIAYPLQSAEDGVATRLQIREESASCLAAEYWSQEPAMRF

SEQ ID NO: 895277 - protein, 120 aa, Homo sapiens [sequence omitted]

SEQ ID NO: 895278 - protein, 120 aa, Homo sapiens [sequence omitted]

SEQ ID NO: 895279 - protein, 77 aa, Homo sapiens
PPPFVRIGIFRLLKGLAHIRCDLFIPVVMEGHICQSLESAKAGTRFPGPQWGCANPRELGKLGSACSLGYPEGGVRR

SEQ ID NO: 895280 - protein, 102 aa, Homo sapiens; identical to SEQ ID NO: 895275

SEQ ID NO: 895281 - protein, 120 aa, Homo sapiens [sequence omitted]

SEQ ID NO: 895282 - protein, 102 aa, Homo sapiens; identical to SEQ ID NO: 895275

SEQ ID NO: 895283 - protein, 133 aa, Homo sapiens
MAWLPGSCARVAFAAGAAARYWTAWQGSAGPNPAAVAEAHGSLFCGRATSARAWSLRRPGPGSPAHSGGVQTRENWIAYPLQSAEDGVATRLQIREESASCLAAEYWSQEPAMRLYSQRMSVPRTSSCHQFGF

SEQ ID NO: 895284 - protein, 102 aa, Homo sapiens; identical to SEQ ID NO: 895275

SEQ ID NO: 895285 - protein, 102 aa, Homo sapiens; identical to SEQ ID NO: 895275

SEQ ID NO: 895286 - protein, 120 aa, Homo sapiens [sequence omitted]

SEQ ID NO: 895287 - protein, 120 aa, Homo sapiens [sequence omitted]

SEQ ID NO: 895288 - protein, 102 aa, Homo sapiens; identical to SEQ ID NO: 895275

SEQ ID NO: 895289 - protein, 101 aa, Homo sapiens
MPGLSWCARAPVLFPVTFRLAFGGHPGEGREMSGAVRETQPEEAPRERSWDIPELRSWAQRRLASLGRQWSHKKKDGIINNRNVFSHSFGDQKSEIRVLAE

SEQ ID NO: 895290 - protein, 106 aa, Homo sapiens
MDHSFVVGPHLPEPGVCEGRDPVPRPTVGVCKPERTGLQIREESASCLAAEYWSQEPAMSRCSLSVPLPWGFLSGGVVSRSCQAPRRKPHQDSLRKQALKNPVTFI

SEQ ID NO: 895291 - protein, 101 aa, Homo sapiens; identical to SEQ ID NO: 895289

SEQ ID NO: 895292 - protein, 38 aa, Homo sapiens
MSVLLVLGALLVLALLEMVALDILVHLLLGIRGLRVTK

SEQ ID NO: 895293 - protein, 109 aa, Homo sapiens
MFPGSLSRGRRAAVEMAWLPGSCARVAFAAGAAARYWTAWQGSAGPNPAAVAEAHGSLFCGRATSARAWSLRRPGPGSPAHSGGVQTRENWIAYPLQSAEDGVATSANS

SEQ ID NO: 895294 - protein, 458 aa, Homo sapiens
VDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKRETSSLSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 895295 - protein, 171 aa, Homo sapiens
DKTGPFRLRNLSKMAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLRTSAGWTSRTSLPCPTLASLRYWWRRCCPIARLWESTGLRA

SEQ ID NO: 895296 - protein, 215 aa, Homo sapiens
SEEKTEVTARYEAGFKIGRGWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQ

SEQ ID NO: 895297 - protein, 142 aa, Homo sapiens
RLCETVLLVQVKGAGHHLMWAKGIQAATCNCGTSCLIYRRLGQTTEVILETRGRHGLNNYGSMNTCSVYTPEYKPNRHYRRKGASFVVLDWLCFCLWTPQCMWLPQHPAPEAPGGQQLPLAPSSPQKLRRRHSASTEAPLWE

SEQ ID NO: 895298 - protein, 185 aa, Homo sapiens
DKTGPFRLRNLSKMAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQ

SEQ ID NO: 895299 - protein, 270 aa, Homo sapiens
RLVRPECMDNLSKMAAPWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 895300 - protein, 270 aa, Homo sapiens; identical to SEQ ID NO: 895299

SEQ ID NO: 895301 - protein, 270 aa, Homo sapiens; identical to SEQ ID NO: 895299

SEQ ID NO: 895302 - protein, 263 aa, Homo sapiens
MWDLVLEDRRMNSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 895303 - protein, 264 aa, Homo sapiens
QNVLRLRYEAGGLSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 895304 - protein, 244 aa, Homo sapiens
SEEKTEVTARYEAGLAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 895305 - protein, 198 aa, Homo sapiens
DKTGPFRLRNLSKMAAPWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLRTSAGWTSRTSLPCPTLASLRYWWRRCCPIARLWESTGLRA

SEQ ID NO: 895306 - protein, 195 aa, Homo sapiens
MSRVTYTYYIGLGKVLKRLEAWGRFRCPADTPFPVSRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 895307 - protein, 144 aa, Homo sapiens
THTHAVLYLPTHTHTHAVLTLAYLPIHTHTHTRTHCPVPPYTHTRCPYTGLPAYTHTHTHTLSCTSLHTHTCCPYTGFLSFSPLFRNLRRLDISDLPAVSNPGLTQILVEEMLPNCEVVGVDWAEGLKSGPEEQPRDTASPVPA

SEQ ID NO: 895308 - protein, 270 aa, Homo sapiens; identical to SEQ ID NO: 895299

SEQ ID NO: 895309 - protein, 270 aa, Homo sapiens; identical to SEQ ID NO: 895299

SEQ ID NO: 895310 - protein, 270 aa, Homo sapiens; identical to SEQ ID NO: 895299

SEQ ID NO: 895311 - protein, 78 aa, Homo sapiens
ARCSRGSPGSLTSGSLNLREPYTSGALTSGTLSMPLFRPGEVKAQAVSSRREPHSPCQETLLKLSLCECTAISCRDPD

SEQ ID NO: 895312 - protein, 270 aa, Homo sapiens; identical to SEQ ID NO: 895299

SEQ ID NO: 895313 - protein, 270 aa, Homo sapiens; identical to SEQ ID NO: 895299

SEQ ID NO: 895314 - protein, 270 aa, Homo sapiens; identical to SEQ ID NO: 895299

SEQ ID NO: 895315 - protein, 212 aa, Homo sapiens
RLVRPECMDNLSKMAAPWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQ

SEQ ID NO: 895316 - protein, 206 aa, Homo sapiens
RTYYGLGTRLGVLSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQ

SEQ ID NO: 895317 - protein, 215 aa, Homo sapiens; identical to SEQ ID NO: 895296

SEQ ID NO: 895318 - protein, 387 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 895319 - protein, 244 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKALAKLGFAKGPGRATSWGWCPPSGCGGGPLLGGPSGAWPPGLR

SEQ ID NO: 895320 - protein, 194 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESESLEISNRAVLGEQHPVAAFEL

SEQ ID NO: 895321 - protein, 372 aa, Homo sapiens
MAAIPALDPEAEPSMDVILVGSSELSSSVSPGTGRDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 895322 - protein, 145 aa, Homo sapiens
MHLCGPSTGQGFIAGWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 895323 - protein, 2302 aa, Homo sapiens
MTSEEMTASVLIPVTQRKVVSAQSAADESSEKVSDINISKAHTVRRSGETSHTISQLNKLKEEPSGSNLPKILSIAREKIVSDENSNEKCWEKIMPDSAKNLNINCNNILRNHQHGLPQRQFYEMYNSVAEEDLCLETGIPSPLERKVFPGIQLELDRPSMGISPLGNQSVIIETGRAHPDSRRAVFHFHYEVDRRMSDTFCTLSENLILDDCGNCVPLPGGEEKQKKNYVAYTCKLMELAKNCDNKNEQLQCDHCDTLNDKYFCFEGSCEKVDMVYSGDSFCRKDFTDSQAAKTFLSHFEDFPDNCDDVEEDAFKSKKERSTLLVRRFCKNDREVKKSVYTGTRAIVRTLPSGHIGLTAWSYIDQKRNGPLLPCGRVMEPPSTVEIRQDGSQRLSEAQWYPIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 895324 - protein, 104 aa, Homo sapiens
MKPRGLPFYKCQQLEKSSRIDLEQGSASLSVKGQTVNILGLGAIKYVATTQFCHCSAKAAIDNTYMNERGCIPIKLYLWTLKQKKKMGLVDLREEALPADYLLR

SEQ ID NO: 895325 - protein, 1994 aa, Homo sapiens
MVSEGSAAGRDFAGMEEVRQLHVRFCKGIKIWHQAWFLCSLLGREPQEREAGCQLWLCTLSAVLKVGWLFPLSEVPNFTLLKDGCGCWRLKEDQIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 895326 - protein, 1994 aa, Homo sapiens; identical to SEQ ID NO: 895325

SEQ ID NO: 895327 - protein, 1103 aa, Homo sapiens [sequence omitted]

SEQ ID NO: 895328 - protein, 318 aa, Homo sapiens
TTHHKLTTTLTYTSRFSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 895329 - protein, 320 aa, Homo sapiens
MCEIDLISIRDNNPARGSTMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 895330 - protein, 319 aa, Homo sapiens
NHDPIVFYTVTSHPTSYTMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 895331 - protein, 319 aa, Homo sapiens
PAHKNVREQNIKNACSYTMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 895332 - protein, 807 aa, Homo sapiens [sequence omitted]

SEQ ID NO: 895333 - protein, 679 aa, Homo sapiens
QPALARWHGRVGGRGGGGGGGGGGGGGEKMATSNNPRKFSEKIALHNQKQAEETAAFEEVMKDLSLTRAARLQLQKSQYLQLGPSRGQYYGGSLPNVNQIGSGTMDLPFQPSGFLGEALAAAPVSLTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 895334 - protein, 589 aa, Homo sapiens
QPALARWHGRVGGRGGGGGGGGGGGGGEKMATSNNPRKFSEKIALHNQKQAEETAAFEEVMKDLSLTRAARLQLQKSQYLQLGPSRGQYYGGSLPNVNQIGSGTMDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQLEQFNMMENAISSSSLYSPGSTLNYSQAAMMGLTGSHGSLPDSQQLGYASHSGIPNIILTVTGESPPSLSKELTTTEDTFRMDRL

SEQ ID NO: 895335 - protein, 435 aa, Homo sapiens
MNNRLRLQKTGSRPKSCEVPGINIFPSADQENTTALIPATHNTGGSLPDLTNIHFPSPLPTPLDPEEPTFPALSSSSSTGNLAANLTHLGIGGAGQGMSTPGSSPQHRPAGVSPLSLSTEARRQQASPTLSPLSPITQAVAMDALSLEQQLPYAFFTQAGSQQPPPQPQPPPPPPPASQQPPPPPPPQAPVRLPPGGPLLPSASLTRGPQPPPLAVTVPSSLPQSPPENPGQPSMGIDIASAPALQQYRTSAGSPANQSPTSPVSNQGFSPGSSPQHTSTLGSVFGDAYYEQQMAARQANALSHQLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 895336 - protein, 454 aa, Homo sapiens
QPALARWHGRVGGRGGGGGGGGGGGGGEKMATSNNPRKFSEKIALHNQKQAEETAAFEEVMKDLSLTRAARLQLQKSQYLQLGPSRGQYYGGSLPNVNQIGSGTMDLPFQTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPATHNTGGSLPDLTNIHFPSPLPTPLDPEEPTFPALSSSSSTGNLAANLTHLGIGGAARLEQFNMMENAISSSSLYSPGSTLNYSQAAMMGLTGSHGSLPDSQQLGYASHSGIPNIILTVTGESPPSLSKELTSSLAGVGDVSFDSDSQFPLDELKIDPLTLDGLHMLNDPDMVLADPATEDTFRMDRL

SEQ ID NO: 895337 - protein, 122 aa, Homo sapiens
LAPPPVMTAGMSPDIASIPGDRVARRACLVRHMDASDGARAKQCLLSPPHPPVTGESPPSLSKELTSSLAGVGDVSFDSDSQFPLDELKIDPLTLDGLHMLNDPDMVLADPATEDTFRMDRL

SEQ ID NO: 895338 - protein, 109 aa, Homo sapiens
RKGRQETPPALLVPAVCRPQADPSQPAGASCPGLRVCCWRRGLSQWHCPLNSPHADSCPYGTMYLSPPADTSWRRSVAGHPPPAPFLLETKPNSHHGYMWKSRTQSLKQ

SEQ ID NO: 895339 - protein, 113 aa, Homo sapiens
MDGRVQLIKALLALPIRPATRRWRNPIPFPETFDGDTDRLPEFIVQTGSYMFVDENTFSSDALKVTFLITRLTGPALQWVIPYIKKESPLLNDYRGFLAEMKRVFGWEEDEDF

SEQ ID NO: 895340 - protein, 113 aa, Homo sapiens; identical to SEQ ID NO: 895339

SEQ ID NO: 895341 - protein, 113 aa, Homo sapiens; identical to SEQ ID NO: 895339

SEQ ID NO: 895342 - protein, 114 aa, Homo sapiens
MYIWTLSCAPAASWAPVTHWTDHPLPPLPSPLLPTRLPDDYIILPTDLRCHSHRHPSHPTDRLLLLVIWTHLGGIWAGHSPWTVIQTAGRPPRDLSPSARPISSPPPETSCVLA

SEQ ID NO: 895343 - protein, 113 aa, Homo sapiens; identical to SEQ ID NO: 895339

SEQ ID NO: 895344 - protein, 113 aa, Homo sapiens; identical to SEQ ID NO: 895339

SEQ ID NO: 895345 - protein, 113 aa, Homo sapiens; identical to SEQ ID NO: 895339

SEQ ID NO: 895346 - protein, 181 aa, Homo sapiens
SGLERKRTPARISGGGSAMVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAVNKQLADKERVAAALENTHLLEVVNQCLSARS

SEQ ID NO: 895347 - protein, 289 aa, Homo sapiens
SGLERKRTPARISGGGSAMVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKTVPDAMTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLMVYDIWEQVG

SEQ ID NO: 895348 - protein, 168 aa, Homo sapiens
AAARPSRPAGAARRAPRPPPPPSLYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAVNKQLADKERVAAALENTHLLEVVNQCLSARS

SEQ ID NO: 895349 - protein, 181 aa, Homo sapiens; identical to SEQ ID NO: 895346

SEQ ID NO: 895350 - protein, 181 aa, Homo sapiens
SGLERKRTPARISGGGSAMVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAGPECVRLQQRRRQPGGGILRRQIRWAQVVEVA

SEQ ID NO: 895351 - protein, 202 aa, Homo sapiens
THASEHAVNKQLADKERVAAALENTHLLEVVNQCLSALLLSLALTPQPAYWYPGPSSCQGCDRGTIVSRSNAEELDILVICKYPLIYNGSEERRPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAARS

SEQ ID NO: 895352 - protein, 68 aa, Homo sapiens
SAMVGGGGVGGGLLENANPLIYQRSGERPVTAGEEDEQVPDSIDAREIFDIRRCWARAGSGGLRWGEQ

SEQ ID NO: 895353 - protein, 181 aa, Homo sapiens; identical to SEQ ID NO: 895346

SEQ ID NO: 895354 - protein, 179 aa, Homo sapiens
SGLERKRTPARISGGGSAMVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAGPECVRLQQRRRQPGGGILRRQISEQATCR

SEQ ID NO: 895355 - protein, 84 aa, Homo sapiens
MLTTSPTGRTRDFDLIRSINDPEHPLTLEELNVVEQVRVQVSDPESTVAVAFTPTIPHCSMATLIGLSGYSGTVGLVGDCRASR

SEQ ID NO: 895356 - protein, 84 aa, Homo sapiens
SGLERKRTPARISGGGSAMVGGGGVGGGLLENANPLIYQRSGERPVTAGEEDEQVPDSIDAREIFDIRRCWARAGSGGLRWGEQ

SEQ ID NO: 895357 - protein, 121 aa, Homo sapiens
IGNAAVVSREEGFLDNAKCPSSSKRSVYRPVTARGGRHNDTFPMAIDALRDLLISRSVLSGSDWAGFRCGRLCCVWCGSDVISELAYEIEQDCNPHHGRYHGKKGSKWARAQSPFSFTSHI

SEQ ID NO: 895358 - protein, 152 aa, Homo sapiens
SGLERKRTPARISGGGSAMVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAARS

SEQ ID NO: 895359 - protein, 84 aa, Homo sapiens; identical to SEQ ID NO: 895356

SEQ ID NO: 895360 - protein, 1509 aa, Homo sapiens
RGPRRARVAVGSSSSNTSSSSSPGGGADPERPGAPRLPGARRGGSSPGAAARALGSAPRLGDPDSRPSERVPRRRPRARGGSGRRQPGRGAATARAGHPQEPQSAEGAAPPSGAGPRGLPGPSPPPGPEGRVIGRAAGRKGGREPPPPAPPPPLAPTPGRRARAARPEAPAMASPPRHGPPGPASGDGPNLNNNNNNNNHSVRKCGYLRKQKHGHKRFFVLRGPGAGGDEATAGGGSAPQPPRLEYYESEKKWRSKAGAPKRVIALDCCLNINKRADAKHKYLIALYTKDEYFAVAAENEQEQEGWYRALTDLVSEGRAAAGDAPPAAAPAASCSASLPGALGGSAGAAGAEDSYGLVAPATAAYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFEFRPRSKSQSSGSSATHPISVPGARRHHHLVNLPPSQTGLVRRSRTDSLAATPPAAKCSSCRVRTASEGDGGAAAGAAAAGARPVSVAGSPLSPGPVRAPLSRSHTLSGGCGGRGSKVALLPAGGALQHSRSMSMPVAHSPPAATSPGSLSSSSGHGSGSYPPPPGPHPPLPHPLHHGPGQRPSSGSASASGSPSDPGFMSLDEYGSSPGDLRAFCSHRSNTPESIAETPPARDGGGGGEFYGYMTMDRPLSHCGRSYRRVSGDAAQDLDRGLRKRTYSLTTPARQRPVPQPSSASLDEYTLMRATFSGSAGRLCPSCPASSPKVAYHPYPEDYGDIEIGSHRSSSSNLGADDGYMPMTPGAALAGSGSGSCRSDDYMPMSPASVSAPKQILQPRAAAAAAAAVPSAGPAGPAPTSAAGRTFPASGGGYKASSPAESSPEDSGYMRMWCGSKLSMEHADGKLLPNGDYLNVSPSDAVTTGTPPDFFSAALHPGGEPLRGVPGCCYSSLPRSYKAPYTCGGDSDQYVLMSSPVGRILEEERLEPQATPGPSQAASAFGAGPTQPPHPVVPSPVRPSGGRPEGFLGQRGRAVRPTRLSLEGLPSLPSMHEYPLPPEPKSPGEYINIDFGEPGARLSPPAPPLLASAASSSSLLSASSPASSLGSGTPGTSSDSRQRSPLSDYMNLDFSSPKSPKPGAPSGHPVGSLDGLLSPEASSPYPPLPPRPSASPSSSLQPPPPPPAPGELYRLPPASAVATAQGPGAASSLSSDTGDNGDYTEMAFGVAATPPQPIAAPPKPEAARVASPTSGVKRLSLMEQVSGVEAFLQASQPPDPHRGAKVIRADPQGGRRRHSSETFSSTTTVTPVSPSFAHNPKRHNSASVENVSLRKSSEGGVGVGPGGGDEPPTSPRQLQPAPPLAPQGRPWTPGQPGGLVGCPGSGGSPMRRETSAGFQNGLNYIAIDVREEPGLPPQPQPPPPPLPQPGDKSSWGRTRSLGGLISAVGVGSTGGGCGGPGPGALPPANTYASIDFLSHHLKEATIVKE

SEQ ID NO: 895361 - protein, 1509 aa, Homo sapiens; identical to SEQ ID NO: 895360

SEQ ID NO: 895362 - protein, 1509 aa, Homo sapiens; identical to SEQ ID NO: 895360

SEQ ID NO: 895363 - protein, 1509 aa, Homo sapiens; identical to SEQ ID NO: 895360

SEQ ID NO: 895364 - protein, 1509 aa, Homo sapiens; identical to SEQ ID NO: 895360

SEQ ID NO: 895365 - protein, 240 aa, Homo sapiens
AGVWGFRGARLCSLPSGAGCRPAGWPAPPPGKMALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVSYLIIQLPS

SEQ ID NO: 895366 - protein, 1120 aa, Homo sapiens
AGVWGFRGARLCSLPSGAGCRPAGWPAPPPGKMALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 895367 - protein, 608 aa, Homo sapiens
AGVWGFRGARLCSLPSGAGCRPAGWPAPPPGKMALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKKTDIFL

SEQ ID NO: 895368 - protein, 537 aa, Homo sapiens
AGVWGFRGARLCSLPSGAGCRPAGWPAPPPGKMALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEVFLYKIDRIYFSLESI

SEQ ID NO: 895369 - protein, 1095 aa, Homo sapiens
CCRLEERGTRHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 895370 - protein, 180 aa, Homo sapiens
CCRLEERGTRHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVSEPFHLTGA

SEQ ID NO: 895371 - protein, 297 aa, Homo sapiens
AGVWGFRGARLCSLPSGAGCRPAGWPAPPPGKMALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTSKKKLWYEGSST

SEQ ID NO: 895372 - protein, 779 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPSDPTRQETPPPRSPPVANSGSTGFSRRGSGRGGGPTPWGPAWDAGIAPPVLPQDEGAWPLRVTLLQSSF

SEQ ID NO: 895373 - protein, 122 aa, Homo sapiens
MMTGGNLDSQGDPLPGVPLPPSDPTRQETPPPRSPPVANSGSTGFSRRGSGRGGGPTPWGPAWDAGIAPPVLPQDEGAWALAGHLFPAFNAPREPIRALGPVLKVPPEILDHLRLGACSGPP

SEQ ID NO: 895374 - protein, 608 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKSKEHHPLLADFRRSPGAGSQPLPSPGY

SEQ ID NO: 895375 - protein, 535 aa, Homo sapiens
MRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRSKEHHPLLADFRRSPGAGSQPLPSPGY

SEQ ID NO: 895376 - protein, 604 aa, Homo sapiens
MEGSRPRSSLSLASSASTISSLSSLSPKKPTRAVNKIHAFGKRGNALRRDPNLPVHIRGWLHKQAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRSKEHHPLLADFRRSPGAGSQPLPSPGY

SEQ ID NO: 895377 - protein, 303 aa, Homo sapiens
QSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRSKEHHPLLADFRRSPGAGSQPLPSPGY

SEQ ID NO: 895378 - protein, 292 aa, Homo sapiens
GRERPAERKEKLGEGGREKVRREIGKRKGRKRQSQSLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPSDPTRQETPPPRSPPVANSGSTGFSRRGSGRGGGPTPWGPAWDAGIAPPVLPQDEGAWPLRVTLLQSSF

SEQ ID NO: 895379 - protein, 591 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGEHPGWVGLYGNSRPHQVPFCLSRSWVSEGLPGFQP

SEQ ID NO: 895380 - protein, 588 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKVSCRSIL

SEQ ID NO: 895381 - protein, 306 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWVPIAGPGGEWFLWPKFGFLNTV

SEQ ID NO: 895382 - protein, 206 aa, Homo sapiens
MEGSRPRSSLSLASSASTISSLSSLSPKDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTHVSRPPRS

SEQ ID NO: 895383 - protein, 140 aa, Homo sapiens
MRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLRRPGLAWEADPEDRERKESDTR

SEQ ID NO: 895384 - protein, 662 aa, Homo sapiens [sequence omitted]

SEQ ID NO: 895385 - protein, 317 aa, Homo sapiens [sequence omitted]

SEQ ID NO: 895386 - protein, 731 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPPVLPQDEGAWPLRVTLLQSSF

SEQ ID NO: 895387 - protein, 662 aa, Homo sapiens [sequence omitted]

SEQ ID NO: 895388 - protein, 382 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSLTPYSPRGMPGSPLRSCHKTRGHGLCESLCYNPASNPPKSGSQSEREDVVWRYRRRSGTTQGIRGRGLVPIAGPGGEWFLWPKFGFLNTV

SEQ ID NO: 895389 - protein, 140 aa, Homo sapiens; identical to SEQ ID NO: 895383

SEQ ID NO: 895390 - protein, 1220 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 895391 - protein, 1220 aa, Homo sapiens; identical to SEQ ID NO: 895390

SEQ ID NO: 895392 - protein, 1220 aa, Homo sapiens; identical to SEQ ID NO: 895390

SEQ ID NO: 895393 - protein, 1220 aa, Homo sapiens; identical to SEQ ID NO: 895390

SEQ ID NO: 895394 - protein, 1220 aa, Homo sapiens; identical to SEQ ID NO: 895390

SEQ ID NO: 895395 - protein, 962 aa, Homo sapiens [sequence omitted]

SEQ ID NO: 895396 - protein, 1184 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 895397 - protein, 1006 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGKNSVSNKASVNCFFSKLIIQDVIMLQIFKSLNSTPDFPFIFNFFLISECLVNLGGQ

SEQ ID NO: 895398 - protein, 193 aa, Homo sapiens
MGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGKNSVSNKASVNCFFSKLIIQDVIMLQIFKSLNSTPDFPFIFNFFLISECLVNLGGQ

SEQ ID NO: 895399 - protein, 1006 aa, Homo sapiens; identical to SEQ ID NO: 895397

SEQ ID NO: 895400 - protein, 144 aa, Homo sapiens
VQQGGWTRSYVFVWSIIYRHQCHQSGGYRGSESSILNSGCVIALSFLNSSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 895401 - protein, 1006 aa, Homo sapiens; identical to SEQ ID NO: 895397

SEQ ID NO: 895402 - protein, 1220 aa, Homo sapiens; identical to SEQ ID NO: 895390

SEQ ID NO: 895403 - protein, 762 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEHREDTTKIWRQ

SEQ ID NO: 895404 - protein, 1007 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGKNSVSNKASVNCFFSKLIIQDVIMLQIFKSDSVGGSVARAREASVSIMRFTHSISQP

SEQ ID NO: 895405 - protein, 759 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEVKIYYYFVFG

SEQ ID NO: 895406 - protein, 291 aa, Homo sapiens
LAGSRTASVRRTEERWKSPEVRWAPGVAMEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 895407 - protein, 263 aa, Homo sapiens
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 895408 - protein, 291 aa, Homo sapiens; identical to SEQ ID NO: 895406

SEQ ID NO: 895409 - protein, 172 aa, Homo sapiens
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIAVSSTLAWLW

SEQ ID NO: 895410 - protein, 237 aa, Homo sapiens
MEESGAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 895411 - protein, 301 aa, Homo sapiens
LAGSRTASVRRTEERWKSPEVRWAPGVAMEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSDQLPARPSQAQAGSSSDLSTVFPHVTSGKALPHLGQRKEDEALLSWPVFGA

SEQ ID NO: 895412 - protein, 291 aa, Homo sapiens; identical to SEQ ID NO: 895406

SEQ ID NO: 895413 - protein, 291 aa, Homo sapiens; identical to SEQ ID NO: 895406

SEQ ID NO: 895414 - protein, 190 aa, Homo sapiens
PLPTSHPSFQHLIPGCVLNKEDLGEFWQEGVEVGAGSPGQLVLMVLSWLLCLRSELLCLWLPSRQLLFIGTGWAGLGWAGLPKVGLYLAARVERGDEVRVMIAGTQGPSGLVFVFARNTVLRWICFFKKLCNSKIMLFLFTYSFSSFLLRAGDDLGSLKLASWPLREKCKSNPVDWLGCDSFSRLEETNI

SEQ ID NO: 895415 - protein, 314 aa, Homo sapiens
LAGSRTASVRRTEERWKSPEVRWAPGVAMEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSVQSEGLDWQAICTGALGVPITLFGNSESGIDGGVLDREAHRKGGHHEGENTVRERESRIDTKTS

SEQ ID NO: 895416 - protein, 170 aa, Homo sapiens
KAGWYPGCKGGSRRKFGGLQASRWRRAGTSRCSVSSLTSTSTASLRGLPTVATGDYPPPDQASSNLTLSPPPGHTHCGNRGQPWPVLGRGGANAAASSSSRPEQGGGSRVSPVSVRRTGLLAAGRALKPYLALRDPGGLPGTLNLVGGGDVTDASLSALTGGLEGILEKP

SEQ ID NO: 895417 - protein, 282 aa, Homo sapiens
MAAAAPDSRVSEEENLKKTPKKKMKMVTGAVASVLEDEATDTSDSEGSCGSEKDHFYSDDDAIEADSEGDAEPCDKENENDGESSVGTNMGWADAMAKVLNKKTPESKPTILVKNKKLEKEKEKLKQERLEKIKQRDKRLEWEMMCRVKPDVVQDKETERNLQRIATRGVVQLFNAVQKHQKNVDEKVKEAGSSMRKRAKLISTVSKKDFISVLRGMDGSTNETASSRKKPKAKQTEVKSEEGPGWTILRDDFMMGASMKDWDKESDGPDDSRPESASDSDT

SEQ ID NO: 895418 - protein, 144 aa, Homo sapiens
MAAAAPDSRVSEEENLKKTPKKKMKMVTGAVASVLEDEATDTSDSEGSCGSEKDHFYSDDDAIEADSEGDAEPCDKENENDGESSVGTNMGWADAMAKVLNKKTPESKPTILVKNKKLEKEKEKLKQERLEKIKQVCSTSSLVD

SEQ ID NO: 895419 - protein, 244 aa, Homo sapiens
LLRCSCVVIRVERLKDHFYSDDDAIEADSEGDAEPCDKENENDGESSVGTNMGWADAMAKVLNKKTPESKPTILVKNKKLEKEKEKLKQERLEKIKQRDKRLEWEMMCRVKPDVVQDKETERNLQRIATRGVVQLFNAVQKHQKNVDEKVKEAGSSMRKRAKLISTVSKKDFISVLRGMDGSTNETASSRKKPKAKQTEVKSEEGPGWTILRDDFMMGASMKDWDKESDGPDDSRPESASDSDT

SEQ ID NO: 895420 - protein, 282 aa, Homo sapiens; identical to SEQ ID NO: 895417

SEQ ID NO: 895421 - protein, 139 aa, Homo sapiens [sequence omitted]

SEQ ID NO: 895422 - protein, 1430 aa, Homo sapiens
HLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 895423 - protein, 1430 aa, Homo sapiens; identical to SEQ ID NO: 895422

SEQ ID NO: 895424 - protein, 1430 aa, Homo sapiens; identical to SEQ ID NO: 895422

SEQ ID NO: 895425 - protein, 1430 aa, Homo sapiens; identical to SEQ ID NO: 895422

SEQ ID NO: 895426 - protein, 1388 aa, Homo sapiens
HLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRNMNED

SEQ ID NO: 895427 - protein, 1383 aa, Homo sapiens
HLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRR

SEQ ID NO: 895428 - protein, 1236 aa, Homo sapiens
HLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKK

SEQ ID NO: 895429 - protein, 592 aa, Homo sapiens
HLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPVRSTLVDLTQVDPTRSVKT

SEQ ID NO: 895430 - protein, 521 aa, Homo sapiens
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 895431 - protein, 108 aa, Homo sapiens
THASPTRRVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 895432 - protein, 132 aa, Homo sapiens
LFRRSPLGPLSIQVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPLMT

SEQ ID NO: 895433 - protein, 119 aa, Homo sapiens
HSVALPPPGPTVVFAGAAVALGLGRGGGRGEEKAAAEAGERRKEAAARRAQQLRRRPGSWECRCGALVGADPAGPGRGKESPARPWRTTRNWTTNGSRISRTKAATWRTTSPLKKTPPA

SEQ ID NO: 895434 - protein, 521 aa, Homo sapiens; identical to SEQ ID NO: 895430

SEQ ID NO: 895435 - protein, 415 aa, Homo sapiens
LFRRSPLGPLSIQVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 895436 - protein, 396 aa, Homo sapiens
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGILAQAASFSVPSRRGR

SEQ ID NO: 895437 - protein, 497 aa, Homo sapiens
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 895438 - protein, 150 aa, Homo sapiens
MIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 895439 - protein, 93 aa, Homo sapiens
MAAGGTGGLREEQRYGLSCGRLGQDNITVLHVKLTETAIRALETYQSHKNLIPFRPSIQFQGLHGVSTLIDLTNKSNVLARYSTFKIRFQLTL

SEQ ID NO: 895440 - protein, 640 aa, Homo sapiens
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQAEEESRNRSTKVIKPGGPYVGKRVQIRKAPQAVSDTVPERKRSTPMNPANTIRKTHSSSTISQRPYRDRVIHLLALKAYKKPELLARLQKDGVNQKDKNSLGAILQQVANLNSKDLSYTLKDYVFKELQRDWPGYSEIDRRSLESVLSRKLNPSQNATGTSRSESPVCSSRDAVSSPQKRLLDSEFIDPLMNKKARISHLTNRVPPTLNGHLNPTSEKSAAGLPLPPAAAAIPTPPPLPSTYLPISHPPQIVNSNSNSPSTPEGRGTQDLPVDSFSQNDSIYEDQQDKYTSRTSLETLPPGSVLLKCPKPMEENHSMSHKKSKKKSKKHKEKDQIKKHDIETIEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQNVHEEVLQEYQKIKQSSPNYHEEKYRCEYLHNKLAHIKRLIGEFDQQQAESWS

SEQ ID NO: 895441 - protein, 640 aa, Homo sapiens; identical to SEQ ID NO: 895440

SEQ ID NO: 895442 - protein, 508 aa, Homo sapiens [sequence omitted]

SEQ ID NO: 895443 - protein, 455 aa, Homo sapiens [sequence omitted]

SEQ ID NO: 895444 - protein, 455 aa, Homo sapiens [sequence omitted]

SEQ ID NO: 895445 - protein, 640 aa, Homo sapiens; identical to SEQ ID NO: 895440

SEQ ID NO: 895446 - protein, 310 aa, Homo sapiens
MNKKARISHLTNRVPPTLNGHLNPTSEKSAAGLPLPPAAAAIPTPPPLPSTYLPISHPPQIVNSNSNSPSTPEGRGTQDLPVDSFSQNDSIYEDQQDKYTSRTSLETLPPGSVLLKCPKPMEENHSMSHKKSKKKSKKHKEKDQIKKHDIETIEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQNVHEEVLQEYQKIKQSSPNYHEEKYRCEYLHNKLAHIKRLIGEFDQQQAESWS

SEQ ID NO: 895447 - protein, 310 aa, Homo sapiens; identical to SEQ ID NO: 895446

SEQ ID NO: 895448 - protein, 640 aa, Homo sapiens; identical to SEQ ID NO: 895440

SEQ ID NO: 895449 - protein, 277 aa, Homo sapiens
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQAEEESRNRSTKVIKPGGPYVGKRVQIRKAPQAVSDTVPERKRSTPMNPANTIRKTHSSSTISQRPYRDRVIHLLALKAYKKPELLARLQKDGVNQKDKNSLGAILQQVRTAGERSFLLTFLLKCSFKKACCHYYHYY

SEQ ID NO: 895450 - protein, 318 aa, Homo sapiens
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQAEEESRNRSTKVIKPGGPYVGKRVQIRKAPQAVSDTVPERKRSTPMNPANTIRKTHSSSTISQRPYRDRVIHLLALKAYKKPELLARLQKDGVNQKDKNSLGAILQQVANLNSKDLSYTLKDYVFKELQRDWPGYSEIDRRSLESVLSRKLNPSQNATGTSRSESPVCSSIKILNLTP

SEQ ID NO: 895451 - protein, 139 aa, Homo sapiens
WRLEPERRRRRHPGEFKMAAGGTGGLREEQRYGLSCGRLGQDNITVLHVKLTETAIRALETYQSHKVSGPAGRLGSERQSAPLTAWPRPGAGPAEPWLAAATVSARSGQAGQGRAGWLTPRSRASLGVGEAGSRAAPGG

SEQ ID NO: 895452 - protein, 4368 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGQVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDHDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVNKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLASGTGGPFTTCHAHVPPESFFKGCVLDVCMGGGDHDILCKALASYVAACQAAGVVIEDWRAQVGCEITCPENSHYEVCGPPCPAS

SEQ ID NO: 895453 - protein, 3582 aa, Homo sapiens
RQERGPISSGLVWFHSGPSGSLCFLFSLFVSLFLGARLWASLCLSLSFCFSFSSSLSFCLGLLVSRFLPFLSLCPLSVSCFLSPPFSVCSLVSLSVSSHPVLGPHPYTPFFLFLSFLLLHLPTEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFNFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGQVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDHDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSEGCIPSEECPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVNKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLASGTGGPFTTCHAHVPPESFFKGCVLDVCMGGGDHDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRVPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 895454 - protein, 3162 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEEALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLASGTGGPFTTCHAHVPPESFFKGCVLDVCMGGGDHDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRVPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 895455 - protein, 440 aa, Homo sapiens
ARSCAQKGDKAFLCRSLAAYTAACAGSWSDDFVLPNGSAASSVETFGAAWRVPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 895456 - protein, 260 aa, Homo sapiens
MLIRGSRFGASCDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 895457 - protein, 242 aa, Homo sapiens
TTVCKTGDQTNDRHDSQEKPAMEKWRAQDFCPLQCPAHSHYELCGDSCPVSCPSLSAPEGCESACREGCVCDAGFVLSGDTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 895458 - protein, 4368 aa, Homo sapiens; identical to SEQ ID NO: 895452

SEQ ID NO: 895459 - protein, 4368 aa, Homo sapiens; identical to SEQ ID NO: 895452

SEQ ID NO: 895460 - protein, 4368 aa, Homo sapiens; identical to SEQ ID NO: 895452

SEQ ID NO: 895461 - protein, 115 aa, Homo sapiens
EDVSTMRMQHQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPW

SEQ ID NO: 895462 - protein, 4368 aa, Homo sapiens; identical to SEQ ID NO: 895452

SEQ ID NO: 895463 - protein, 1395 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSEYSHPDLEEASACVLAEPVCCKQHDNFSALGAIPTCEPSRT

SEQ ID NO: 895464 - protein, 137 aa, Homo sapiens
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 895465 - protein, 137 aa, Homo sapiens; identical to SEQ ID NO: 895464

SEQ ID NO: 895466 - protein, 113 aa, Homo sapiens
MLSGRLVLGLVSMAGRVCLCQGSAGSGAIGPVEAAIRTKLEEALSPEVLDSRFEGLSPLQRHRLVHAALAEELGGPVHALAIQARTPAQWRENSQLDTSPPCLGGNKKTLGTP

SEQ ID NO: 895467 - protein, 137 aa, Homo sapiens; identical to SEQ ID NO: 895464

SEQ ID NO: 895468 - protein, 137 aa, Homo sapiens; identical to SEQ ID NO: 895464

SEQ ID NO: 895469 - protein, 36 aa, Homo sapiens
MTDFVSIYQSLRATLKPLICMPGSLKRAGFQTKYWF

SEQ ID NO: 895470 - protein, 131 aa, Homo sapiens
IAVEGKDGPVQSSLGPGGKTPRLCSLPAPLRLRLWSGRDGQGASRMEAAETPVFQLGQGELICGLWAVPLGVATSAHGPWHLGNMGAAALGPCVGAEQDGCCVEGNFVPWRVIGDPLPCCCCLQAPGLYYL

SEQ ID NO: 895471 - protein, 131 aa, Homo sapiens; identical to SEQ ID NO: 895470

SEQ ID NO: 895472 - protein, 378 aa, Homo sapiens
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 895473 - protein, 159 aa, Homo sapiens
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGVSQKCIPPCLTHFSGSAPPLVFLLLVIQNLQKNQQSFYLMKWS

SEQ ID NO: 895474 - protein, 133 aa, Homo sapiens
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGFDLLHVACMPLELGLFS

SEQ ID NO: 895475 - protein, 133 aa, Homo sapiens; identical to SEQ ID NO: 895474

SEQ ID NO: 895476 - protein, 326 aa, Homo sapiens
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKGWGDTEFSKQYVSVSRPGRLALCPSEKIAEQQVEVVHGFSKQSGE

SEQ ID NO: 895477 - protein, 186 aa, Homo sapiens
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFVCRHQSSCVPRAPAGL

SEQ ID NO: 895478 - protein, 115 aa, Homo sapiens [sequence omitted]

SEQ ID NO: 895479 - protein, 112 aa, Homo sapiens
MDLAGLLKSQFLCHLVFCYVFIASGLIINTIQLFTLLLWPINKQLFRKINCRLSYCISSRGSHWKTSLKTMTSARPGCTSSTRRRMPFRRSTTGRAPSQRRPWCPPGGPGPS

SEQ ID NO: 895480 - protein, 159 aa, Homo sapiens; identical to SEQ ID NO: 895473

SEQ ID NO: 895481 - protein, 1039 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895482 - protein, 413 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSQIQQSWVNTT

SEQ ID NO: 895483 - protein, 107 aa, Homo sapiens
MLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSVSI

SEQ ID NO: 895484 - protein, 911 aa, Homo sapiens
MDILSKKEENTLVGLFNFVFPTSFQDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895485 - protein, 876 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895486 - protein, 528 aa, Homo sapiens
MAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895487 - protein, 1063 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRFNVLIKLPVMQVCYISSFLARADRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895488 - protein, 474 aa, Homo sapiens [sequence omitted]

SEQ ID NO: 895489 - protein, 380 aa, Homo sapiens [sequence omitted]

SEQ ID NO: 895490 - protein, 1039 aa, Homo sapiens; identical to SEQ ID NO: 895481

SEQ ID NO: 895491 - protein, 1039 aa, Homo sapiens; identical to SEQ ID NO: 895481

SEQ ID NO: 895492 - protein, 1039 aa, Homo sapiens; identical to SEQ ID NO: 895481

SEQ ID NO: 895493 - protein, 561 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSVSI

SEQ ID NO: 895494 - protein, 985 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895495 - protein, 664 aa, Homo sapiens
MIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895496 - protein, 585 aa, Homo sapiens
MLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895497 - protein, 523 aa, Homo sapiens
VNSANRIVDVLVTALKVSSRCSAMKGVEFFTCWSTFKPFRPGRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895498 - protein, 491 aa, Homo sapiens
VNSANRIVDVLVTALKVSSRCSAMKGVEFFTCWSTFKPFRPGRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895499 - protein, 1021 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 895500 - protein, 1039 aa, Homo sapiens; identical to SEQ ID NO: 895481

SEQ ID NO: 895501 - protein, 717 aa, Homo sapiens
KRDSPSRSGWGRESEGCGERRWDRCGQRGGERRPRQRAAERRRHRVQSIVDQGAMDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNR

SEQ ID NO: 895502 - protein, 170 aa, Homo sapiens
AEARARSGPDPGGLGGRTMDSGTEEYELNGGLPPGTPGSPDASPARWGWRHGPINVNHYASKKSAAESMLDIALLMANASQLKAVVEQGPSFAFYVPLVVLISISLVLQIGVGVLLIFLVKYDLNNPDKHAKLDFLNNLATGLVFIIVVVNIFITAFGVQKPLMDMAPQQ

SEQ ID NO: 895503 - protein, 180 aa, Homo sapiens
AEARARSGPDPGGLGGRTMDSGTEEYELNGGLPPGTPGSPDASPARWGWRHGPINVNHYASKKSAAESMLDIALLMANASQLKAVVEQGPSFAFYVPLVVLISISLVLQIGVGVLLIFLGRSPGGGSQATCSPCWHLLASPGTGAHHLAHLALKELPSSWPSSPRHAVQEVAPPLPPPCT

SEQ ID NO: 895504 - protein, 170 aa, Homo sapiens; identical to SEQ ID NO: 895502

SEQ ID NO: 895505 - protein, 111 aa, Homo sapiens
MFQQNRCIFLWATKLILNATESPVMSQDSLTAGVGPLPLSQAGALLSGLPLAPSTPLSPTVKYDLNNPDKHAKLDFLNNLATGLVFIIVVVNIFITAFGVQKPLMDMAPQQ

SEQ ID NO: 895506 - protein, 123 aa, Homo sapiens
RVLLSVGRAVTAISTQLPDPRSRHTCEVSTSLHMALPRLPEPRLASSAPCPRTSPCSDCGQAPRRRPLLSLSSCSQEAAPSWHMGAGHNSPEGQNWTAAETCAQRRVSTHSRTHSRSVDGLDE

SEQ ID NO: 895507 - protein, 121 aa, Homo sapiens
AEARARSGPDPGGLGGRTMDSGTEEYELNGGLPPGTPGSPDASPARWGWRHGPINVNHYASKKSAAESMLDIALLMANASQLKAVVEQGPSFAFYVPLVVLISISLVLQIGVGVLLIFLAW

SEQ ID NO: 895508 - protein, 104 aa, Homo sapiens
MTLGTRLRVRHSLHMALPRLPEPRLASSAPCPRTSPCSDCGQAPRRRPLLSLSSCSQEAAPSWHMGAGHNSPEGQNWTAAETCAQRRVSTHSRTHSRSVDGLDE

SEQ ID NO: 895509 - protein, 170 aa, Homo sapiens; identical to SEQ ID NO: 895502

SEQ ID NO: 895510 - protein, 70 aa, Homo sapiens
PGVLLSWCAAVLVVLLIFLVKYDLNNPDKHAKLDFLNNLATGLVFIIVVVNIFITAFGVQKPLMDMAPQQ

SEQ ID NO: 895511 - protein, 93 aa, Homo sapiens
VLVLGRSQSKGWSGDMVQMRPAWALAVWVVPCAGRRPLLSLSSCSQEAAPSWHMGAGHNSPEGQNWTAAETCAQRRVSTHSRTHSRSVDGLDE

SEQ ID NO: 895512 - protein, 146 aa, Homo sapiens
VDHSVYILEDSIVDPQNQTMTTFTWNINHARLMVVKERCVYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFV

SEQ ID NO: 895513 - protein, 146 aa, Homo sapiens; identical to SEQ ID NO: 895512

SEQ ID NO: 895514 - protein, 116 aa, Homo sapiens
SFSLAGVESGLVIALPELGLLVCTGGGRRVNTTFLVEPGPEEIGVMGEEIRLVFQASSKGSHLPFATGEAPSKTLVETAKEAKEKAKETALAATEKAKDLASKAATKKQQQQQQFV

SEQ ID NO: 895515 - protein, 146 aa, Homo sapiens; identical to SEQ ID NO: 895512

SEQ ID NO: 895516 - protein, 146 aa, Homo sapiens; identical to SEQ ID NO: 895512

SEQ ID NO: 895517 - protein, 135 aa, Homo sapiens
VDHSVYILEDSIVDPQNQTMTTFTWNINHARLMVVKERCVYCVNSDNSGWTEIRREAWVSSSLFGVSRAVQEFGLARFKSNVTKTMKGFEYILAKLQGEAPSKTLVETAKEAKEKAKDLASKAATKKQQQQQQFV

SEQ ID NO: 895518 - protein, 146 aa, Homo sapiens; identical to SEQ ID NO: 895512

SEQ ID NO: 895519 - protein, 77 aa, Homo sapiens
REESVCFSFAFRQDCRFPEASPAFQNCASGYEVQRLCFGFAFDAILDVLSSAIVLWRYSNAAAVHSAHREYIAFSLH

SEQ ID NO: 895520 - protein, 76 aa, Homo sapiens
VKKVSVSPLPSARIVGFLRPPQPFRTVSVMRYSASAFGFAFDAILDVLSSAIVLWRYSNAAAVHSAHREYIAFSLH

SEQ ID NO: 895521 - protein, 102 aa, Homo sapiens
MLPVSRTCLLESSTRLKPHEAQNYRKKALWVSWFSIIVTLALAVAAFTVSVMRYSASAFGFAFDAILDVLSSAIVLWRYSNAAAVHSAHREYMTISCSVSPF

SEQ ID NO: 895522 - protein, 289 aa, Homo sapiens
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFTVSVMRYSASAFGFAFDAILDVLSSAIVLWRYSNAAAVHSAHREYIACVILGVIFLLSSICIVVKAIHDLSTRLLPEVDDFLFSVSILSGILCSILAVLKFMLGKVLTSRALITDGFNSLVGGVMGFSILLSAEVFKHDSAVWYLDGSIGVLIGLTIFAYGVKLLIDMVPRVRQTRHYEMFE

SEQ ID NO: 895523 - protein, 326 aa, Homo sapiens
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFTVSVMRYSASAFGFAFDAILDVLSSAIVLWRYSNAAAVHSAHREYIACVILGVIFLLSSICIVVKAIHDLSTRLLPEVDDFLFSVSILSGILCSILAVLKFMLGKVLTSRALITDGFNSLVGGVMGFSILLSAEVFKHDSAVWYLDGSIGVLIGLTIFAYGVKSFHIGKGCQYLTEHLVSFWKFSFTWFVITRQGLPSQVDLPCPHHLPPPSNMLGQCP

SEQ ID NO: 895524 - protein, 73 aa, Homo sapiens
VKKVSVSPLPSARIVGFLRPPQPFRTVSVMRYSASAFGFAFDAILDVLSSAIVLWRYSNAAAVHSAHREYIGT

SEQ ID NO: 895525 - protein, 212 aa, Homo sapiens
MEDTPLVISKQKTEVVCGVPTQVVCTAFSSHILVVVTQFGKMGTLVSLEPSSVASDVSKPVLTTKVLLGQDEPLIHVFAKNLVALCLKKLETEQSSSPAVKDKSMEGLKALSGGDPGCLPGVGGPREAARPRGCFRPGPPLNTPEHPTSGKFKVFTLPSPRVEGTGTFGHLGPWEATDKQTPVSPGRTSYSWLLDAIWALTGGLDPVRGVWN

SEQ ID NO: 895526 - protein, 76 aa, Homo sapiens; identical to SEQ ID NO: 895520

SEQ ID NO: 895527 - protein, 108 aa, Homo sapiens
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFI

SEQ ID NO: 895528 - protein, 1217 aa, Homo sapiens
MARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895529 - protein, 327 aa, Homo sapiens
GDSPVGPASAGPGAATWFLRATALWAWELPLRNTPQEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKVLCSSLNLSPARYVTVKTIIIKDHLQKRQGIPSKSRLPSYLDKVLKKRILNFLTESGWISRDAS

SEQ ID NO: 895530 - protein, 420 aa, Homo sapiens
MAELGKKYCVYCLAEVSPLRFRCTECQDIELCPECFSAGAEIGHHRRYHGYQLVDGGRFTLWGPEAEGGWTSREEQLLLDAIEQFGFGNWEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 895531 - protein, 1323 aa, Homo sapiens
MARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDTSAAPRRRGPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQDIAALTPLRLTKRAGKEPDSTGTREIGSSLGLRFTAGKWASVLEPCSQSVVPGPAEQHPCHLGACGKWEFWARPRPVEPEALGAGQQAIWTGLWMTVMPAHLENHRPGEHLNTDGSWLRLEKTQAMSGTRGRWTSTLPQPQGSMMPSSLRRMSFIFSLPCVFNPTLSAAREGQTLHTQEGRSQSHSRFICHQTHGRRQTGSRRMTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895532 - protein, 1383 aa, Homo sapiens
MDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQCIAALTPLRLTKRAGKEPDSTGTREIGSSLGLRFTAGKWASVLEPCSQSVVPGPAEQHPCHLGACGKWEFWARPRPVEPEALGAGQQAIWTGLWMTVMPAHLENHRPGEHLNTDGSWLRLEKTQAMSGTRGRWTSTLPQPQGSMMPSSLRRMSFIFSLPCVFNPTLSAAREGQTLHTQEGRSQSHSRFICHQTHGRRQTGSRRMTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895533 - protein, 1459 aa, Homo sapiens
MENLPAVTTEEPTPMGRGPVGPSGGGSTRDQVRTVVMRPSVSWEKAGPEEAKAPVRGDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGGLLGSPRTPSTDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQDIAALTPLRLTKRAGKEPDSTGTREIGSSLGLRFTAGKWASVLEPCSQSVVPGPAEQHPCHLGACGKWEFWARPRPVEPEALGAGQQAIWTGLWMTVMPAHLENHRPGEHLNTDGSWLRLEKTQAMSGTRGRWTSTLPQPQGSMMPSSLRRMSFIFSLPCVFNPTLSAAREGQTLHTQEGRSQSHSRFICHQTHGRRQTGSRRMTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895534 - protein, 1031 aa, Homo sapiens
QAVRPRCKDETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGAPQPPCPTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQDIAALTPLRLTKRAGKEPDSTGTREIGSSLGLRFTAGKWASVLEPCSQSVVPGPAEQHPCHLGACGKWEFWARPRPVEPEALGAGQQAIWTGLWMTVMPAHLENHRPGEHLNTDGSWLRLEKTQAMSGTRGRWTSTLPQPQGSMMPSSLRRMSFIFSLPCVFNPTLSAAREGQTLHTQEGRSQSHSRFICHQTHGRRQTGSRRMTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895535 - protein, 215 aa, Homo sapiens
VGAAGSLTHLPVWQDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895536 - protein, 997 aa, Homo sapiens
MARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQDIAALTPLRLTKRAGKEPDSTGTREIGSSLGLRFTAGKWASVLEPCSQSVVPGPAEQHPCHLGACGKWEF

SEQ ID NO: 895537 - protein, 262 aa, Homo sapiens
LWVAWSPGAQERVGCMPFGLSWLKTVSKGRWLYVGTELGHPSPTLPKPHGRWGQALLVLFVDGKVSLGAGKGLARTAQVTAVPGGEPGAAGVCMPAPGSHVLTPAPLACTPGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895538 - protein, 381 aa, Homo sapiens
MAELGKKYCVYCLAEVSPLRFRCTECQDIELCPECFSAGAEIGHHRRYHGYQLVDGGRFTLWGPEAEGGWTSREEQLLLDAIEQFGFGNWEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKVLCSSLNLSPARYVTVKTIIIKDHLQKRQGIPSKSRLPSYLDKVLKKRILNFLTESGWISRDAS

SEQ ID NO: 895539 - protein, 1435 aa, Homo sapiens
MARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQDIAALTPLRLTKRAGKEPDSTGTREIGSSLGLRFTAGKWASVLEPCSQSVVPGPAEQHPCHLGACGKWEFWARPRPVEPEALGAGQQAIWTGLWMTVMPAHLENHRPGEHLNTDGSWLRLEKTQAMSGTRGRWTSTLPQPQGSMMPSSLRRMSFIFSLPCVFNPTLSAARKGRTLHTQEGRSQSHSRFICHQTHGRRQTGSRRMTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895540 - protein, 1336 aa, Homo sapiens
MARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALCGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAQDIAALTPLRLTKRAGKEPDSTGTREIGSSLGLRFTAGKWASVLEPCSQSVVPGPAEQHPCHLGACGKWEFWARPRPVEPEALGAGQQAIWTGLWMTVMPAHLENHRPGEHLNTDGSWAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895541 - protein, 997 aa, Homo sapiens; identical to SEQ ID NO: 895536

SEQ ID NO: 895542 - protein, 122 aa, Homo sapiens
MTFHFTGGSSFSVQFPNPKADPAPHLNTARACWFTLGRAVPLGQAPIVTTSPRMGKHVSGRDVGHVWTARPSQSIFRGCSVLLLRRECISLGRTHCTKFKAKSSEFWRQLPQDFLQLQVPFH

SEQ ID NO: 895543 - protein, 305 aa, Homo sapiens
MTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 895544 - protein, 997 aa, Homo sapiens; identical to SEQ ID NO: 895536

SEQ ID NO: 895545 - protein, 104 aa, Homo sapiens
MCRVIFSLLALGFRGASVQQHWVLLRGHAQLVVEGVVPDLLHVVPVGDDAISLGSSFKDVHGTFLLKLEEVFCLPAAQGSLVQDPALKRVFGVLRLQRSVLQGG

SEQ ID NO: 895546 - protein, 88 aa, Homo sapiens
NRKAELRLCNKLVALLATLEEPQEGLEFAHMALALSITLGKPPEPLPCQDPHFARAQPPGLQGRSRNSCRIFLVSCPGRHICPAGSPV

SEQ ID NO: 895547 - protein, 116 aa, Homo sapiens
MGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 895548 - protein, 191 aa, Homo sapiens
RSPVIAATREVEVAVSQDRAIALQPGQLRLKKIRKERKKRKRPSQEVVGLGRPRVRQDLEAGVEAREWSASTVPACPHPTEGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGEWCLNLWKRKQN

SEQ ID NO: 895549 - protein, 118 aa, Homo sapiens
VAIGGLKYSKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGEWCLNLWKRKQN

SEQ ID NO: 895550 - protein, 222 aa, Homo sapiens
RSPVIAATREVEVAVSQDRAIALQPGQLRLKKIRKERKKRKRPSQEVVGLGRPRVRQDLEAGVEAREWSASTVPACPHPTEGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAGIFKPRFAMRGCATESMCFTKPGAEVPTGTNVLFLHHIECTHSP

SEQ ID NO: 895551 - protein, 222 aa, Homo sapiens; identical to SEQ ID NO: 895550

SEQ ID NO: 895552 - protein, 189 aa, Homo sapiens
RSPVIAATREVEVAVSQDRAIALQPGQLRLKKIRKERKKRKRPSQEVVGLGRPRVRQDLEAGVEAREWSASTVPACPHPTEGKELVHTYKGCIRSQDCYSGVISTTMGPKDHMVTSSFCCQSDGCNSAFLSVPLTNLTENGLMCPACTASFRDKCMGPMTHCTGKENHCVSLSGHVQAESYSVSQAGVQ

SEQ ID NO: 895553 - protein, 440 aa, Homo sapiens [sequence omitted]

SEQ ID NO: 895554 - protein, 440 aa, Homo sapiens [sequence omitted]

SEQ ID NO: 895555 - protein, 141 aa, Homo sapiens
VQFRRALTAAASSTSSEDVIVNDSLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 895556 - protein, 115 aa, Homo sapiens
MSSCRGQKVAGGLRVVSPFPLCQPAGEPSRGKMRSSCVLLTALVALAAYYVYIPLPGSVSDPWKLMLLDATFRGAQQVVRCSPALLLSSSSYAIFEGDTKFLRRVPRKRRFFLMH

SEQ ID NO: 895557 - protein, 78 aa, Homo sapiens
AHYGVVTFRSQEKKKAGLLTPTTYVLDEDEPRFLEEVDYSAESNDELDIELAENVGDYEPSAQEEVLSDSELSRTYLP

SEQ ID NO: 895558 - protein, 1186 aa, Homo sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 895559 - protein, 1213 aa, Homo sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKNKCQESCRQRICPSAFNNLCRLAPHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 895560 - protein, 1185 aa, Homo sapiens
MFEKKIVCYFSEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 895561 - protein, 1108 aa, Homo sapiens
MNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 895562 - protein, 1064 aa, Homo sapiens
MNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTRNLGSSELQFLPPIL

SEQ ID NO: 895563 - protein, 1108 aa, Homo sapiens; identical to SEQ ID NO: 895561

SEQ ID NO: 895564 - protein, 1144 aa, Homo sapiens
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKNVWQSGLWILFVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 895565 - protein, 1108 aa, Homo sapiens; identical to SEQ ID NO: 895561

SEQ ID NO: 895566 - protein, 77 aa, Homo sapiens
VTRSAYWEAGSAGAHFDQHPTTYVLDEDEPRFLEEVDYSAESNDELDIELAENVGDYEPSAQEEVLSDSELSRTYLP

SEQ ID NO: 895567 - protein, 273 aa, Homo sapiens
GVAFRGREESRSRRRPAGRALAPRSRGWAGAGRGLGAGPGPGTAGEGQLPEPGSQAAQGRGQLAPVLRSPGPRCEAAAPPARERTMGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGGELRPASARSPSRRARPAAPQA

SEQ ID NO: 895568 - protein, 256 aa, Homo sapiens
GVAFRGREESRSRRRPAGRALAPRSRGWAGAGRGLGAGPGPGTAGEGQLPEPGSQAAQGRGQLAPVLRSPGPRCEAAAPPARERTMGAPLAVALGALHYLALFLQLGGATRPAGHAPWDNHVSGHALFTETPHDMTARTGEDVEMACSFRGSGSPSYSLEIQWWYVRSHRDWTDKQAWASNQVVKVVGSNISHKLRLSRVKPTDEGTYECRVIDFSDGKARHHKVKAYLRVQPGGELRPASARSPSRRARPAAPQA

SEQ ID NO: 895569 - protein, 295 aa, Homo sapiens
GVAFRGREESRSRRRPAGRALAPRSRGWAGAGRGLGAGPGPGTAGEGQLPEPGSQAAQGRGQLAPVHCCDLLCVPEIVMAGCACRPVSPAVCWALMCGGPCVRLIAACGCPSHFTLCSVFLANFWRAAHAGPAWPTAALWTTLSPGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGGELRPASARSPSRRARPAAPQA

SEQ ID NO: 895570 - protein, 239 aa, Homo sapiens
AGQRAGAVRRSQAECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGKSWEPVRIGL

SEQ ID NO: 895571 - protein, 240 aa, Homo sapiens
VISVTGRRFVLHNWSVGDNRKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKLAGRPAVLARSPHILRLGVRA

SEQ ID NO: 895572 - protein, 620 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895573 - protein, 620 aa, Homo sapiens; identical to SEQ ID NO: 895572

SEQ ID NO: 895574 - protein, 628 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGELFAFLNPTIGGNYFGLKRSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895575 - protein, 585 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKGRWPPGRWEAESSVHGPSELFLSLWGALVPSIMGKSELLNLDQKGNLKMPSTESGLSSFS

SEQ ID NO: 895576 - protein, 514 aa, Homo sapiens
MVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895577 - protein, 642 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKRKNNLHLSTQNKLEASLFSPKKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895578 - protein, 620 aa, Homo sapiens; identical to SEQ ID NO: 895572

SEQ ID NO: 895579 - protein, 620 aa, Homo sapiens; identical to SEQ ID NO: 895572

SEQ ID NO: 895580 - protein, 603 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVISLESEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895581 - protein, 616 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLPRTWIPLCEGLGAHWGRGTIQGGGGGTHWGPAKGSAATGTRHPENT

SEQ ID NO: 895582 - protein, 586 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPGGPVIGRCLKR

SEQ ID NO: 895583 - protein, 627 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRFLDSLFLGRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895584 - protein, 659 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRSVSFCYQAGMQWRDLSSLQPPPPRFKRFSCLSLLSSWDYSRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895585 - protein, 479 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSVFESCCQ

SEQ ID NO: 895586 - protein, 627 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALAAWPVHLQNLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895587 - protein, 491 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGMGPSLFSASLSCNPRRHP

SEQ ID NO: 895588 - protein, 459 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEETVA

SEQ ID NO: 895589 - protein, 600 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALAVSYEFFQLEAERFENLREIGNLLHPSVPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895590 - protein, 379 aa, Homo sapiens
MVARCQSSPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895591 - protein, 411 aa, Homo sapiens
SYQQKVCGFISGRYATSSRGASERQIPILCLSDGSKTPSSPISNDEDVDNKVERIWGDCTVRKKYSHVDLVVMVDGFEGEKGAVVAGSRGYFLKGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895592 - protein, 572 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEGVLVFLEQALIQYALRTLGSRGYIPIYTPFFMRKEVMQEVAQLSQFDEELYKVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895593 - protein, 520 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEVIGKGSEKSDDNSYDEKYLIATSEQPIAALHRDEWLRPEDLPIKYAGLSTCFRQEVGSHGRDTRGIFRVHQFEKIEQFVYSSPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNATMCATTRTICAILENYQTEKGITVPEKLKEFMPPGLQELIPFVKPAPIEQEPSKKQKKQHEGSKKKAAARDVTLENRLQNMEVTDA

SEQ ID NO: 895594 - protein, 377 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEDVDNKVERIWGDCTVRKKYSHVDLVVMVDGFEGEKGAVGALCRRPDGVLSCTGRSWLFLDQALHAQYCPLSASPLRHTVRGLPFPMLIPPLSLHWTRPRDGVPSPSARRWRPPAFRPLDADL

SEQ ID NO: 895595 - protein, 315 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADALANLKVSQIKKVRLLIDEAILKCDAERIKLEAERFENLREIGNLLHPSVPISNDEKLKEFMPPGLQELIPFVKPAPIEQEPSKKQKKQHEGSKKKAAARDVTLENRLQNMEVTDA

SEQ ID NO: 895596 - protein, 184 aa, Homo sapiens
WRIRHEGEKRFKDPGLVDQLVKADSEWRRCRFRADNLNKLKNLCSKTIGEKMKKKEPVGDDESVPENVLSFDDLTADASSMMESDIFDECCGAILASLSVGPGGKKMVLDLDLFRVDKGGDPALIRETQEKRFKDPGLVDQLVKADSEWRRCRFRADNLNKLKNLCSKTIGEKMKVRELNNKQP

SEQ ID NO: 895597 - protein, 63 aa, Homo sapiens
MVITIYYDVKVRFIVRGCGQYISYRCQEKRNTYFAEYWYQAQCCQYELFNVMDTPCRESYEYH

SEQ ID NO: 895598 - protein, 146 aa, Homo sapiens
MVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 895599 - protein, 146 aa, Homo sapiens; identical to SEQ ID NO: 895598

SEQ ID NO: 895600 - protein, 146 aa, Homo sapiens; identical to SEQ ID NO: 895598

SEQ ID NO: 895601 - protein, 273 aa, Homo sapiens
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 895602 - protein, 273 aa, Homo sapiens; identical to SEQ ID NO: 895601

SEQ ID NO: 895603 - protein, 232 aa, Homo sapiens
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 895604 - protein, 590 aa, Homo sapiens
PCPAPPPSSGGAAVGALHRVLGKGLSLAPSPAAPLPAPRRRSASRPAPPRVTSAPPPRAPAPPPLRVPLSLPESCFLLPRGRDPEPPEAGAAAPCAPGAPDMSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 895605 - protein, 551 aa, Homo sapiens
MGPLGGVRSVGGREGGASPNPGDSCGCHYEEQEREGASGPLGRDPEPPEAGAAAPCAPGAPDMSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 895606 - protein, 590 aa, Homo sapiens; identical to SEQ ID NO: 895604

SEQ ID NO: 895607 - protein, 590 aa, Homo sapiens; identical to SEQ ID NO: 895604

SEQ ID NO: 895608 - protein, 607 aa, Homo sapiens
PCPAPPPSSGGAAVGALHRVLGKGLSLAPSPAAPLPAPRRRSASRPAPPRVTSAPPPRAPAPPPLRVPLSLPESCFLLPRGRDPEPPEAGAAAPCAPGAPDMSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEPRPRPKPAPSFPHCSCGGCLRPGELLDL

SEQ ID NO: 895609 - protein, 71 aa, Homo sapiens
LPRPAPFFRRSCGGGAPPGPRKGALSGPVPGGPAPGPPAPLSLPPSPSARDLGPAPASPCPAPAPGPSVTS

SEQ ID NO: 895610 - protein, 71 aa, Homo sapiens; identical to SEQ ID NO: 895609

SEQ ID NO: 895611 - protein, 71 aa, Homo sapiens; identical to SEQ ID NO: 895609

SEQ ID NO: 895612 - protein, 533 aa, Homo sapiens
MQSGDPEAALIAYVDVSHTRPHVHLTYAIYAINMRLAHYTSSTRDMIASRANPSSNKLTKMLMDDYYSGCPVFILGTSYTVMRRVCRSRRFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 895613 - protein, 605 aa, Homo sapiens
PCPAPPPSSGGAAVGALHRVLGKGLSLAPSPAAPLPAPRRRSASRPAPPRVTSAPPPRAPAPPPLRVPLSLPESCFLLPRGRDPEPPEAGAAAPCAPGAPDMSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEELYRLDSLHPDLIYNVSWNHNGSLFCSACKDKSVRIIDPRRGTLVAEREKAHEGARPMRAIFLADGKVFTTGFSRMSERQLALWDPGVRRFCLAWLPAMCQENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 895614 - protein, 240 aa, Homo sapiens
MCQENLEEPMALQELDSSNGALLPFYDPDTSVVYVCGKGDSSIRYFEITEEPPYIHFLNTFTSKEPQRGMGSMPKRGLEVSKCEIARFYKLHERKCEPIVMTVPRKSDLFQDDLYPDTAGPEAALEAEEWVSGRDADPILISLREAYVPSKQRDLKISRRNVLSDSRPAMAPGSSHLGAPASTTTAADATPSGSLARAGEAGKLEEVMQELRALRALVKEQGDRICRLEEQLGRMENGDA

SEQ ID NO: 895615 - protein, 140 aa, Homo sapiens [sequence omitted]

SEQ ID NO: 895616 - protein, 268 aa, Homo sapiens
PCPAPPPSSGGAAVGALHRVLGKGLSLAPSPAAPLPAPRRRSASRPAPPRVTSAPPPRAPAPPPLRVPLSLPESCFLLPRGRDPEPPEAGAAAPCAPGAPDMSFRKVVRQSKFRHVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLEGHTKRVGIIAWHPTARNVLLSAGCDNVVLIWNVGTAEE

SEQ ID NO: 895617 - protein, 81 aa, Homo sapiens
LIYNVSWNHNGSLFCSACKDKSVRIIDPRRGTLVAVRGSGGQGWLWMAQDLEQGAALTSLSPRQEREKAHEGARPMRAIFL

SEQ ID NO: 895618 - protein, 202 aa, Homo sapiens
MAKVSVLNVAVLENPSPFHSPFRFEISFECSEALADDLEWKIIYVGSAESEEFDQILDSVLVGPVPAGRHMFVFQADAPNPSLIPETDAVGVTVVLITCTYHGQEFIRVGYYVNNEYLNPELRENPPMKPDFSQLQRNILASNPRVTRFHINWDNNMDRLEAIETQDPSLGCGLPLNCTPIKGLGLPGCIPGLLPENSMDCI

SEQ ID NO: 895619 - protein, 195 aa, Homo sapiens
TQILPAQRNIWLNPRVTRFHINWDNNMDRLEAIETQDPSLGCGLPLNCTPIKGLGLPGCIPGLLPENSMDCIYLQEPRVSQHAGRGNQASQRVLPPAGRHMFVFQADAPNPSLIPETDAVGVTVVLITCTYHGQEFIRVGYYVNNEYLNPELRENPPMKPDFSQVGPVSTSCFPQGRSLYLGGVQPFKLRVKVTS

SEQ ID NO: 895620 - protein, 202 aa, Homo sapiens; identical to SEQ ID NO: 895618

SEQ ID NO: 895621 - protein, 202 aa, Homo sapiens; identical to SEQ ID NO: 895618

SEQ ID NO: 895622 - protein, 232 aa, Homo sapiens
TQILPAQRNIWLNPRVTRFHINWDNNMDRLEAIETQDPSLGCGLPLNCTPIKGLGLPGCIPGLLPENSMDCIYLQEPRVSQHAGRGNQASQRVLPPAGRHMFVFQADAPNPSLIPETDAVGVTVVLITCTYHGQEFIRVGYYVNNEYLNPELRENPPMKPDFSQLQRNILASNPRVTRFHINWDNNMDRLEAIETQDPSLGCGLPLNCTPIKGLGLPGCIPGLLPENSMDCI

SEQ ID NO: 895623 - protein, 143 aa, Homo sapiens
MAKVSVLNVAVLENPSPFHSPFRFEISFECSEALADDLEWKIIYVGSAESEEFDQILDSVLVGPVPAGRHMFVFQLQRNILASNPRVTRFHINWDNNMDRLEAIETQDPSLGCGLPLNCTPIKGLGLPGCIPGLLPENSMDCI

SEQ ID NO: 895624 - protein, 146 aa, Homo sapiens
MAVIGQRAEAGYLKAARGLGAHFSSRREEAGVDLVSPTPLTPPDPGAASATATAPAPAAARRGEAMAKVSVLNVAVLENPSPFHSPFRFEISFECSEALADDLEWKIIYVGSAESEEFDQILDSVLVGPVPAGRHMFVFQRLMPWV

SEQ ID NO: 895625 - protein, 175 aa, Homo sapiens
MAKVSVLNVAVLENPSPFHSPFRFEISFECSEALADDLEWKIIYVGSAESEEFDQILDSVLVGPVPAGRHMFVFQADAPNPSLIPETDAVGVTVVLITCTYHGQEFIRVGYYVNNEYLNPELRENPPMKPDFSQSQLHRRLRQENRLNPEGRGCSETRSQHCTPAWATKAKLRLK

SEQ ID NO: 895626 - protein, 431 aa, Homo sapiens
GRPPTAPHTGRPPTANRGDPRLDLKRGCARLLTSIESRGRPAASAGLRRDRCALRRWPLRRAPLARATRRRAGSPRRCAPRPAPAPRMVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 895627 - protein, 431 aa, Homo sapiens; identical to SEQ ID NO: 895626

SEQ ID NO: 895628 - protein, 431 aa, Homo sapiens; identical to SEQ ID NO: 895626

SEQ ID NO: 895629 - protein, 431 aa, Homo sapiens; identical to SEQ ID NO: 895626

SEQ ID NO: 895630 - protein, 317 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCN

SEQ ID NO: 895631 - protein, 332 aa, Homo sapiens
GRPPTAPHTGRPPTANRGDPRLDLKRGCARLLTSIESRGRPAASAGLRRDRCALRRWPLRRAPLARATRRRAGSPRRCAPRPAPAPRMVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIRKVYQ

SEQ ID NO: 895632 - protein, 122 aa, Homo sapiens
MGKCISRYSGLRKEKEKTEAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 895633 - protein, 343 aa, Homo sapiens
GRPPTAPHTGRPPTANRGDPRLDLKRGCARLLTSIESRGRPAASAGLRRDRCALRRWPLRRAPLARATRRRAGSPRRCAPRPAPAPRMVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKVISRYSGLRKEKEKTEAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 895634 - protein, 317 aa, Homo sapiens; identical to SEQ ID NO: 895630

SEQ ID NO: 895635 - protein, 244 aa, Homo sapiens
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 895636 - protein, 244 aa, Homo sapiens; identical to SEQ ID NO: 895635

SEQ ID NO: 895637 - protein, 244 aa, Homo sapiens; identical to SEQ ID NO: 895635

SEQ ID NO: 895638 - protein, 244 aa, Homo sapiens; identical to SEQ ID NO: 895635

SEQ ID NO: 895639 - protein, 244 aa, Homo sapiens; identical to SEQ ID NO: 895635

SEQ ID NO: 895640 - protein, 242 aa, Homo sapiens
ERERERERERERERERERERNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 895641 - protein, 244 aa, Homo sapiens; identical to SEQ ID NO: 895635

SEQ ID NO: 895642 - protein, 244 aa, Homo sapiens; identical to SEQ ID NO: 895635

SEQ ID NO: 895643 - protein, 244 aa, Homo sapiens; identical to SEQ ID NO: 895635

SEQ ID NO: 895644 - protein, 244 aa, Homo sapiens; identical to SEQ ID NO: 895635

SEQ ID NO: 895645 - protein, 244 aa, Homo sapiens; identical to SEQ ID NO: 895635

SEQ ID NO: 895646 - protein, 244 aa, Homo sapiens; identical to SEQ ID NO: 895635

SEQ ID NO: 895647 - protein, 244 aa, Homo sapiens; identical to SEQ ID NO: 895635

SEQ ID NO: 895648 - protein, 244 aa, Homo sapiens; identical to SEQ ID NO: 895635

SEQ ID NO: 895649 - protein, 378 aa, Homo sapiens
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRILEVAKCPTEADPADSRNKEEERQREGTGALEKPDPVAAGSPGLKAPQAPFAGLEQLSKARRRSRPRFFAHPPVPRADQRHGCYVCGKSFAWRSTLVEHIYSHRGEKPFHCADCGKGFGHASSLSKHRAIHRGERPHRCPECGRAFMRRTALTSHLRVHTGEKPYRCPQCGRCFGLKTGMAKHQWVHRPGGEGRRGRRPGGLSVTLTPVRGDLDPPVGFQLYPEIFQECG

SEQ ID NO: 895650 - protein, 378 aa, Homo sapiens; identical to SEQ ID NO: 895649

SEQ ID NO: 895651 - protein, 378 aa, Homo sapiens; identical to SEQ ID NO: 895649

SEQ ID NO: 895652 - protein, 378 aa, Homo sapiens; identical to SEQ ID NO: 895649

SEQ ID NO: 895653 - protein, 148 aa, Homo sapiens
MAVASDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 895654 - protein, 148 aa, Homo sapiens; identical to SEQ ID NO: 895653

SEQ ID NO: 895655 - protein, 130 aa, Homo sapiens
MAVASDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSIFYYLVQDLKCLVFSLIGLHFKIKPI

SEQ ID NO: 895656 - protein, 72 aa, Homo sapiens
TKMAVASDFYLRYYVGHKGKFGHEFLEFEFRPDGEKRPTARGAGKGERDREAGWCGGYRRRRPLLPSKEIGA

SEQ ID NO: 895657 - protein, 148 aa, Homo sapiens; identical to SEQ ID NO: 895653

SEQ ID NO: 895658 - protein, 102 aa, Homo sapiens
MIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 895659 - protein, 1175 aa, Homo sapiens
MKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 895660 - protein, 1113 aa, Homo sapiens
MAQPLTMNSSLQQPKAGRERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 895661 - protein, 1289 aa, Homo sapiens
MVLTLLLDITILVPSDFLFPHHLRESKSAPSTLFQSHSHNLSLGFPLSFSLDYCTASDSVPAKPATWEGKQSDGQTGSPQNSNSSFSSSVKVENTLLGLGKKSFQRSERLHTRQMKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 895662 - protein, 1175 aa, Homo sapiens; identical to SEQ ID NO: 895659

SEQ ID NO: 895663 - protein, 1160 aa, Homo sapiens
MKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 895664 - protein, 1175 aa, Homo sapiens; identical to SEQ ID NO: 895659

SEQ ID NO: 895665 - protein, 138 aa, Homo sapiens
MREKGRRKKGRTWAEAAKTVLEKYPNTPMSHKEILQVIQREGLKEIRSGTSPLACLNAMLHTNSRGEEGIFYKVPGRMGVYTLKKDVPDGVKELSEGSEESSDGQSDSQSSENSSSSSDGGSNKEGKKSRWKRKGKST

SEQ ID NO: 895666 - protein, 1175 aa, Homo sapiens; identical to SEQ ID NO: 895659

SEQ ID NO: 895667 - protein, 1435 aa, Homo sapiens
MREKGRRKKGRTWAEAAKTVLEKYPNTPMSHKEILQVIQREGLKEIRSGTSPLACLNAMLHTNSRGEEGIFYKVPGRMGVYTLKKDVPDGVKELSEGSEESSDGQSDSQSSENSSSSSDGGSNKEGKKSRWKRKVSSSSPQSGCPSPTIPAGKVISPSQKHSKKALKQALKQQQQKKQQQQCRPSISISSNQHLSLKTVKAASDSVPAKPATWEGKQSDGQTGSPQNSNSSFSSSVKVENTLLGLGKKSFQRSERLHTRQMKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 895668 - protein, 1175 aa, Homo sapiens; identical to SEQ ID NO: 895659

SEQ ID NO: 895669 - protein, 1175 aa, Homo sapiens; identical to SEQ ID NO: 895659

SEQ ID NO: 895670 - protein, 98 aa, Homo sapiens
GPQETNMKEPLATLVDQSPESLKRKSSLTQEEAPVSWEKRPRVTENRQHQQPFQVSPQPFLNRGDRIQVRKVPPLKVREWRELEKQRSSEPYVFGHTY

SEQ ID NO: 895671 - protein, 125 aa, Homo sapiens
MHTVTSQKCPPSFCPLRVSSREREKFCRCMWRTASTAADSDSSSGTRPGRGRLLTDSKAALPGASLYFYTVLLRYNLHAIQPIYFKCTMQGVCIYSQSCVSITIVLEHSSLQKKLLPISSHCPFP

SEQ ID NO: 895672 - protein, 125 aa, Homo sapiens; identical to SEQ ID NO: 895671

SEQ ID NO: 895673 - protein, 125 aa, Homo sapiens; identical to SEQ ID NO: 895671

SEQ ID NO: 895674 - protein, 125 aa, Homo sapiens; identical to SEQ ID NO: 895671

SEQ ID NO: 895675 - protein, 100 aa, Homo sapiens
DTMDYTMPWVSVSQTILTAALTLLSTVVTTPTSSLVIKDSPCSLPPQDSIILILFKDPSPVAAVSAVTFCLLRARAQSSSRILGSSHNILSHDRCEKYVL

SEQ ID NO: 895676 - protein, 100 aa, Homo sapiens; identical to SEQ ID NO: 895675

SEQ ID NO: 895677 - protein, 110 aa, Homo sapiens
MSSFLPEGGCYELLTVIGMCRGRPYSPAFCSRGCCSFLSSPRCVYSRGHPLVRRIHGHRLASVGLLCFFMPSMGRDQTSRKEALLPSFLCGCHVSGVLAIVSQKGWLRRN

SEQ ID NO: 895678 - protein, 269 aa, Homo sapiens
MSFLTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQISFRCSRLTVDPSCEAAAIKERPWLNEGRCWTSPGMILRMRAPRAKNPQTTSRQP

SEQ ID NO: 895679 - protein, 373 aa, Homo sapiens
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 895680 - protein, 280 aa, Homo sapiens
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTRPVPAPS

SEQ ID NO: 895681 - protein, 394 aa, Homo sapiens
MSFLTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 895682 - protein, 373 aa, Homo sapiens; identical to SEQ ID NO: 895679

SEQ ID NO: 895683 - protein, 402 aa, Homo sapiens
MSFLVSKPERIRTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 895684 - protein, 231 aa, Homo sapiens
MSFLVSKPERIRRWVSEKFIVEGLRDLELFGEQPPGDTRRKTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRISRVMMPSLTSTVWESQPVNWPTAMSPLRICLPPRCC

SEQ ID NO: 895685 - protein, 147 aa, Homo sapiens
MSPSRSVANSGLSDSLTTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 895686 - protein, 373 aa, Homo sapiens; identical to SEQ ID NO: 895679

SEQ ID NO: 895687 - protein, 373 aa, Homo sapiens; identical to SEQ ID NO: 895679

SEQ ID NO: 895688 - protein, 204 aa, Homo sapiens
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQGAFSKGHQCLA

SEQ ID NO: 895689 - protein, 176 aa, Homo sapiens
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLRVLSPRAISVLPSLRA

SEQ ID NO: 895690 - protein, 233 aa, Homo sapiens
MSFLVSKPERIRTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQGAFSKGHQCLA

SEQ ID NO: 895691 - protein, 144 aa, Homo sapiens
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRCVLRRPFP

SEQ ID NO: 895692 - protein, 431 aa, Homo sapiens
MSFLVSKPERIRRWVSEKFIVEGLRDLELFGEQPPGDTRRKTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 895693 - protein, 431 aa, Homo sapiens; identical to SEQ ID NO: 895692

SEQ ID NO: 895694 - protein, 325 aa, Homo sapiens [sequence omitted]

SEQ ID NO: 895695 - protein, 349 aa, Homo sapiens
MTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKLNGTVPCLLDTSTIPAEELTMSPSRSVANSGLSDSLTTSTPRPSNGDSPSHPYHRTFSPHFHHFVEQCLQRNPDARPSASTLLNHSFFKQIKRRASEALPELLRPVTPITNFEGSQSQDHSGIFGLVTNLEELEVDDWEF

SEQ ID NO: 895696 - protein, 150 aa, Homo sapiens [sequence omitted]

SEQ ID NO: 895697 - protein, 443 aa, Homo sapiens
WRPGLSLQVTDGAGRPCPSPARCCRPPGVWSPAAARGLSVCRCCRLHPASAMDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 895698 - protein, 443 aa, Homo sapiens; identical to SEQ ID NO: 895697

SEQ ID NO: 895699 - protein, 77 aa, Homo sapiens
WRPGLSLQVTDGAGRPCPSPARCCRPPGVWSPAVRSSLQQAGQQGGAAGLGRQRHCDGGADRALRGGARPGARMVLT

SEQ ID NO: 895700 - protein, 451 aa, Homo sapiens
WRPGLSLQVTDGAGRPCPSPARCCRPPGVWSPAAARGLSVCRCCRLHPASAMDLFGDLPEPERSPRPAAGKEAQKGPLLFDDLPPASSTDSGTVFRLLPGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 895701 - protein, 272 aa, Homo sapiens
MQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 895702 - protein, 443 aa, Homo sapiens; identical to SEQ ID NO: 895697

SEQ ID NO: 895703 - protein, 443 aa, Homo sapiens; identical to SEQ ID NO: 895697

SEQ ID NO: 895704 - protein, 532 aa, Homo sapiens
WRPGLSLQVTDGAGRPCPSPARCCRPPGVWSPAAARGLSVCRCCRLHPASAMDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEVRNLTRGWWCPNCVLVFREVEVLRPHFLPLWDSPCALFQCELCLLTHWSVCPASPDGDQSSSSSWQSCLRKVTGCGVTPFTHSLSHLVGDEKIQTREGKSAADARYEAACNRLANKAVQRGSADNVTVMVVRIGH

SEQ ID NO: 895705 - protein, 403 aa, Homo sapiens
WRPGLSLQVTDGAGRPCPSPARCCRPPGVWSPAAARGLSVCRCCRLHPASAMDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRFILLACDGLFKVFTPEEAVNFILSCLEDEKIQTREGKSAADARYEAACNRLANKAVQRGSADNVTVMVVRIGH

SEQ ID NO: 895706 - protein, 330 aa, Homo sapiens
WRPGLSLQVTDGAGRPCPSPARCCRPPGVWSPAAARGLSVCRCCRLHPASAMDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVR

SEQ ID NO: 895707 - protein, 313 aa, Homo sapiens
WRPGLSLQVTDGAGRPCPSPARCCRPPGVWSPAAARGLSVCRCCRLHPASAMDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRVCGSGATHLDDNTFYGEKTLARTC

SEQ ID NO: 895708 - protein, 329 aa, Homo sapiens
MAEAGTGEPSPSVEGEHGTEYDTLPSDTVSLSDSDSDLSLPGGAEVEALSPMGLPGEEDSGPDEPPSPPSGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSPHGGLQEVEALSGSVHSGSVPGLPPVETVGFHGSRKRSRDHFRNKSSSPEDPGAEV

SEQ ID NO: 895709 - protein, 329 aa, Homo sapiens; identical to SEQ ID NO: 895708

SEQ ID NO: 895710 - protein, 329 aa, Homo sapiens; identical to SEQ ID NO: 895708

SEQ ID NO: 895711 - protein, 329 aa, Homo sapiens; identical to SEQ ID NO: 895708

SEQ ID NO: 895712 - protein, 329 aa, Homo sapiens; identical to SEQ ID NO: 895708

SEQ ID NO: 895713 - protein, 329 aa, Homo sapiens; identical to SEQ ID NO: 895708

SEQ ID NO: 895714 - protein, 329 aa, Homo sapiens; identical to SEQ ID NO: 895708

SEQ ID NO: 895715 - protein, 79 aa, Homo sapiens
CFRAGPKGRGVEEERGERMRTGLHVPTGVGSGGPVPCGSCSSAGAEAVVLGRQSTRFPRGLSAPHGGAAPTKMETAEQP

SEQ ID NO: 895716 - protein, 265 aa, Homo sapiens
MAEAGTGLLPATVQPFHLRGMSSTFSQRSRDIFDCLEGAARRAPSSVAHTSMSDNGGFKRPLAPSGRSPVEGLGRAHRSPASPRVPPVPDYVAHPERWTKYSLEDVTEVSEQSNQATALAFLGSQSLAAPTDCVSSFNQDPSSCGEGRVIFTKPVRGVEARHERKRVLGKVGEPGRGGLGNPATDRGEGPVELAHLAGPGSPEAEEWGSPHGGLQEVEALSGSVHSGSVPGLPPVETVGFHGSRKRSRDHFRNKSSSPEDPGAEV

SEQ ID NO: 895717 - protein, 102 aa, Homo sapiens [sequence omitted]

SEQ ID NO: 895718 - protein, 102 aa, Homo sapiens [sequence omitted]

SEQ ID NO: 895719 - protein, 102 aa, Homo sapiens [sequence omitted]

SEQ ID NO: 895720 - protein, 56 aa, Homo sapiens
MAEAGTGEPSPSVEGEHGTEYDTLPSDTVSLSDSDSDLSLPGGAEVEALSPMGLPG

SEQ ID NO: 895721 - protein, 86 aa, Homo sapiens
PKPGSCLTQCIHCSPRGKLCANRLLKELGQIESREIAWHNKEPVYSLDFQHGTAGRIHRLASAGVDTNVRVNWGRDRHPGTLLEAI

SEQ ID NO: 895722 - protein, 559 aa, Homo sapiens
MKVITCEIAWHNKEPVYSLDFQHGTAGRIHRLASAGVDTNVRIWKVEKGPDGKAIVEFLSNLARHTKAVNVVRFSPTGEILASGGDDAVILLWKVNDNKEPEQIAFQDEDEAQLNKENWTVVKTLRGHLEDVYDICWATDGNLMASASVDNTAIIWDVSKGQKISIFNEHKSYVQGVTWDPLGQYVATLSCDRVLRVYSIQKKRVAFNVSKMLSGIGAEGEARSYRMFHDDSMKSFFRRLSFTPDGSLLLTPAGCVESGENVMNTTYVFSRKNLKRPIAHLPCPGKATLAVRCCPVYFELRPVVETGVELMSLPYRLVFAVASEDSVLLYDTQQSFPFGYVSNIHYHTLSDISWSSDGAFLAISSTDGYCSFVTFEKDELGIPLKEKPVLNMRTPDTAKKTKSQTHRGSSPGPRPVEGTPASRTQDPSSPGTTPPQARQAPAPTVIRDPPSITPAVKSPLPGPSEEKTLQPSSQNTKAHPSRRVTLNTLQAWSKTTPRRINLTPLKTDTPPSSVPTSVISTPSTEEIQSETPGDAQGSPPELKRPRLDENKGGTESLDP

SEQ ID NO: 895723 - protein, 559 aa, Homo sapiens; identical to SEQ ID NO: 895722

SEQ ID NO: 895724 - protein, 559 aa, Homo sapiens; identical to SEQ ID NO: 895722

SEQ ID NO: 895725 - protein, 348 aa, Homo sapiens [sequence omitted]

SEQ ID NO: 895726 - protein, 332 aa, Homo sapiens
MKVITCEIAWHNKEPVYSLDFQHGTAGRIHRLASAGVDTNVRIWKVEKGPDGKAIVEFLSNLARHTKAVNVVRFSPTGEILASGGDDAVILLWKVNDNKEPEQIAFQDEDEAQLNKENWTVVKTLRGHLEDVYDICWATDGNLMASASVDNTAIIWDVSKGQKISIFNEHKSYVQGVTWDPLGQYVATLSCDRVLRVYSIQKKRVAFNVSKMLSGIGAEGEARSYRMFHDDSMKSFFRRLSFTPDGSLLLTPGVELMSLPYRLVFAVASEDSVLLYDTQQSFPFGYVSNIHYHTLSDISCCIFSLVFAFKQACDFCSNFPLLSRCESVGKVC

SEQ ID NO: 895727 - protein, 280 aa, Homo sapiens
MKVITCEIAWHNKEPVYSLDFQHGTAGRIHRLASAGVDTNVRIWKVEKGPDGKAIVEFLSNLARHTKAVNVVRFSPTGEILASGGDDAVILLWKVNDNKEPEQIAFQDEDEAQLNKENWTVVKTLRGHLEDVYDICWATDGNLMASASVDNTAIIWDVSKGQKISIFNEHKSYVQGVTWDPLGQYVATLSCDRHSLTLSPRQVLWRNLTISAHCNLCLLVSSDSPVSASLLAGITGTCHHARLIFVFLVETGFHHVGQAVLKLLTSNDLPALANVLGLQA

SEQ ID NO: 895728 - protein, 510 aa, Homo sapiens
AGGGVLAMAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNMKLLPVDCERKTDEFCQAKQKAALLELLHELYNFLAIQAGNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 895729 - protein, 379 aa, Homo sapiens
AGGGVLAMAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVKLLPVDCERKTDEFCQAKQKAALLELLHELYNFLAIQAGNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 895730 - protein, 471 aa, Homo sapiens
AGGGVLAMAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNSNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 895731 - protein, 201 aa, Homo sapiens
MEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 895732 - protein, 510 aa, Homo sapiens; identical to SEQ ID NO: 895728

SEQ ID NO: 895733 - protein, 358 aa, Homo sapiens
AGGGVLAMAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNMKLLPVDCERKTDEFCQAKQKAALLELLHELYNFLAIQAGNFECGNPENLKSKCIPVMEAQEYIALLSARSLSSESSPCVLICGRQERGSKQEIPQLPPETLTTPL

SEQ ID NO: 895734 - protein, 510 aa, Homo sapiens; identical to SEQ ID NO: 895728

SEQ ID NO: 895735 - protein, 448 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 895736 - protein, 120 aa, Homo sapiens
LSGSDRGRSFSFFLLPSPSLPLLILSRSAALQCDESESSSHPARAFLLLPALLLNGGTVGGGGAAAEEWGAASRDDVGAEPESATQAGEDEDEEEDDEEEEDESSSSDGGEEESSAESLV

SEQ ID NO: 895737 - protein, 448 aa, Homo sapiens; identical to SEQ ID NO: 895735

SEQ ID NO: 895738 - protein, 448 aa, Homo sapiens; identical to SEQ ID NO: 895735

SEQ ID NO: 895739 - protein, 448 aa, Homo sapiens; identical to SEQ ID NO: 895735

SEQ ID NO: 895740 - protein, 448 aa, Homo sapiens; identical to SEQ ID NO: 895735

SEQ ID NO: 895741 - protein, 448 aa, Homo sapiens; identical to SEQ ID NO: 895735

SEQ ID NO: 895742 - protein, 448 aa, Homo sapiens; identical to SEQ ID NO: 895735

SEQ ID NO: 895743 - protein, 448 aa, Homo sapiens; identical to SEQ ID NO: 895735

SEQ ID NO: 895744 - protein, 448 aa, Homo sapiens; identical to SEQ ID NO: 895735

SEQ ID NO: 895745 - protein, 448 aa, Homo sapiens; identical to SEQ ID NO: 895735

SEQ ID NO: 895746 - protein, 391 aa, Homo sapiens
LSGSDRGRSFSFFLLPSPSLPLLILSRSAALQCDESESSSHPARAFLLLPALFYFSFGRRRHCCTQLVSVPRFYPQVVPAAYGPGRLGYFCSRVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 895747 - protein, 354 aa, Homo sapiens
MALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 895748 - protein, 448 aa, Homo sapiens; identical to SEQ ID NO: 895735

SEQ ID NO: 895749 - protein, 448 aa, Homo sapiens; identical to SEQ ID NO: 895735

SEQ ID NO: 895750 - protein, 281 aa, Homo sapiens
MKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 895751 - protein, 356 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSSAEA

SEQ ID NO: 895752 - protein, 364 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDESAEA

SEQ ID NO: 895753 - protein, 448 aa, Homo sapiens; identical to SEQ ID NO: 895735

SEQ ID NO: 895754 - protein, 448 aa, Homo sapiens; identical to SEQ ID NO: 895735

SEQ ID NO: 895755 - protein, 239 aa, Homo sapiens
LSGSDRGRSFSFFLLPSPSLPLLILSRSAALQCDESESSSHPARAFLLLPALFYFSFGRRRHCCTQLVSVPRFYPQVVPAAYGPGRLGYFCSRVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENG

SEQ ID NO: 895756 - protein, 448 aa, Homo sapiens; identical to SEQ ID NO: 895735

SEQ ID NO: 895757 - protein, 356 aa, Homo sapiens; identical to SEQ ID NO: 895751

SEQ ID NO: 895758 - protein, 135 aa, Homo sapiens
HFFPFFEILYPPPKRNFGPLGQKFRPKGPLDFSKVYYGVLCKIPSYHVTFFNHLTRRGNCFLPSLHVVHCCGPEMPNLFKDGATLSPWLDYTGLELHGISTLPYLQESCSIRNSSELQISHVNDTVTFKKCLYCI

SEQ ID NO: 895759 - protein, 296 aa, Homo sapiens
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENG

SEQ ID NO: 895760 - protein, 199 aa, Homo sapiens
SVALSSCLLGKMASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCTHEHRIFPLKH

SEQ ID NO: 895761 - protein, 98 aa, Homo sapiens
RSNKNWHTSIDHILIHACCQTCISSVASRRICSARAEENPPLPEEDLSKLFKPPQPPARMDSLLIAGQINTYCQNIKEFTAQNLGKLFMAQALQEYNN

SEQ ID NO: 895762 - protein, 93 aa, Homo sapiens
DASQRHEQRRLILQISGISSVASRRICSARAEENPPLPEEDLSKLFKPPQPPARMDSLLIAGQINTYCQNIKEFTAQNLGKLFMAQALQEYNN

SEQ ID NO: 895763 - protein, 97 aa, Homo sapiens
HNIKTLFNHRPPIDKLDFMYNISSVASRRICSARAEENPPLPEEDLSKLFKPPQPPARMDSLLIAGQINTYCQNIKEFTAQNLGKLFMAQALQEYNN

SEQ ID NO: 895764 - protein, 82 aa, Homo sapiens
GERVRVIVTGAAPMSTSVMTFFRAAMGCQVYEAFFKPPQPPARMDSLLIAGQINTYCQNIKEFTAQNLGKLFMAQALQEYNN

SEQ ID NO: 895765 - protein, 95 aa, Homo sapiens
PVYRGNSQPNRIGQPRKCCISSVASRRICSARAEENPPLPEEDLSKLFKPPQPPARMDSLLIAGQINTYCQNIKEFTAQNLGKLFMAQALQEYNN

SEQ ID NO: 895766 - protein, 199 aa, Homo sapiens; identical to SEQ ID NO: 895760

SEQ ID NO: 895767 - protein, 199 aa, Homo sapiens; identical to SEQ ID NO: 895760

SEQ ID NO: 895768 - protein, 199 aa, Homo sapiens; identical to SEQ ID NO: 895760

SEQ ID NO: 895769 - protein, 220 aa, Homo sapiens
ERLDQEKSQGVYYIPNRPVLTSSTSWCESTKKMASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCTHEHRIFPLKH

SEQ ID NO: 895770 - protein, 199 aa, Homo sapiens; identical to SEQ ID NO: 895760

SEQ ID NO: 895771 - protein, 199 aa, Homo sapiens; identical to SEQ ID NO: 895760

SEQ ID NO: 895772 - protein, 199 aa, Homo sapiens; identical to SEQ ID NO: 895760

SEQ ID NO: 895773 - protein, 199 aa, Homo sapiens; identical to SEQ ID NO: 895760

SEQ ID NO: 895774 - protein, 199 aa, Homo sapiens; identical to SEQ ID NO: 895760

SEQ ID NO: 895775 - protein, 199 aa, Homo sapiens; identical to SEQ ID NO: 895760

SEQ ID NO: 895776 - protein, 199 aa, Homo sapiens; identical to SEQ ID NO: 895760

SEQ ID NO: 895777 - protein, 199 aa, Homo sapiens; identical to SEQ ID NO: 895760

SEQ ID NO: 895778 - protein, 199 aa, Homo sapiens; identical to SEQ ID NO: 895760

SEQ ID NO: 895779 - protein, 181 aa, Homo sapiens
MSPASSASQPASVTGDNVMGPTREISAGDTQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCTHEHRIFPLKH

SEQ ID NO: 895780 - protein, 236 aa, Homo sapiens
ERLDQEKSQGVYYIPNRPVLTSSTSWCESTKKMASRKEGTGSTATSSSSTAGAAGKGKGKGGSGDSAVKQVQIDGLFSGQVSSQKPFLDPPKVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCTHEHRIFPLKH

SEQ ID NO: 895781 - protein, 146 aa, Homo sapiens
RCSFFLSAWKDGVPQGRYRLYCHLFQLHRRRSRERQRQRRLGRFSREASADRWPFQYQMEMMRSLRHVNIDHLHVGWYQSTYYGSFVTRALLDSQFSYQHAIEESVVLIYDPIKTAQGSLSLKAYRLTPKLMEVCTHEHRIFPLKH

SEQ ID NO: 895782 - protein, 199 aa, Homo sapiens; identical to SEQ ID NO: 895760

SEQ ID NO: 895783 - protein, 199 aa, Homo sapiens; identical to SEQ ID NO: 895760

SEQ ID NO: 895784 - protein, 132 aa, Homo sapiens
SVALSSCLLGKMASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEAIIWGERIYTFADGTEWTEMSPRYS

SEQ ID NO: 895785 - protein, 154 aa, Homo sapiens
SVALSSCLLGKMASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQSQSVCL

SEQ ID NO: 895786 - protein, 70 aa, Homo sapiens
GVFEVPRMKCLWMQVSLDAKCLWMQSVTAACQVDSLLMRQINTYCQNIKEFTAQNLGKLFMAQALQEYNN

SEQ ID NO: 895787 - protein, 178 aa, Homo sapiens
GVDQISDACTHGVRAGQGALRGGAVQGAAGAAGHVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCTHEHRIFPLKH

SEQ ID NO: 895788 - protein, 199 aa, Homo sapiens; identical to SEQ ID NO: 895760

SEQ ID NO: 895789 - protein, 199 aa, Homo sapiens; identical to SEQ ID NO: 895760

SEQ ID NO: 895790 - protein, 146 aa, Homo sapiens; identical to SEQ ID NO: 895781

SEQ ID NO: 895791 - protein, 483 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 895792 - protein, 197 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPLLYLEPNGPDQFLEDLCILN

SEQ ID NO: 895793 - protein, 483 aa, Homo sapiens; identical to SEQ ID NO: 895791

SEQ ID NO: 895794 - protein, 415 aa, Homo sapiens [sequence omitted]

SEQ ID NO: 895795 - protein, 464 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 895796 - protein, 429 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 895797 - protein, 180 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEVHLVV

SEQ ID NO: 895798 - protein, 457 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRCKESDSPHAVTVYMLEPHSCQYILGVESPVICKILDTADENGLLSLPN

SEQ ID NO: 895799 - protein, 435 aa, Homo sapiens
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLK

SEQ ID NO: 895800 - protein, 368 aa, Homo sapiens [sequence omitted]

SEQ ID NO: 895801 - protein, 359 aa, Homo sapiens
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 895802 - protein, 305 aa, Homo sapiens
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 895803 - protein, 359 aa, Homo sapiens; identical to SEQ ID NO: 895801

SEQ ID NO: 895804 - protein, 252 aa, Homo sapiens
MRRSTPGVLPAAVGGARVRRAVGLSGTGAEAGRAGAMVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPG

SEQ ID NO: 895805 - protein, 188 aa, Homo sapiens
MFFRKLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPG

SEQ ID NO: 895806 - protein, 216 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPG

SEQ ID NO: 895807 - protein, 216 aa, Homo sapiens; identical to SEQ ID NO: 895806

SEQ ID NO: 895808 - protein, 216 aa, Homo sapiens; identical to SEQ ID NO: 895806

SEQ ID NO: 895809 - protein, 216 aa, Homo sapiens; identical to SEQ ID NO: 895806

SEQ ID NO: 895810 - protein, 216 aa, Homo sapiens; identical to SEQ ID NO: 895806

SEQ ID NO: 895811 - protein, 216 aa, Homo sapiens; identical to SEQ ID NO: 895806

SEQ ID NO: 895812 - protein, 152 aa, Homo sapiens
MLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPG

SEQ ID NO: 895813 - protein, 224 aa, Homo sapiens
MRGSAYCSVEKRGCASAGVPYQLSDGGGQIRVIAVATGVPETVRALVILVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPG

SEQ ID NO: 895814 - protein, 216 aa, Homo sapiens; identical to SEQ ID NO: 895806

SEQ ID NO: 895815 - protein, 175 aa, Homo sapiens
TTARYEAGVKLAEAGAMVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAMGFFLGWLHSLKHQRNTFLCVSDLLLQGCHS

SEQ ID NO: 895816 - protein, 216 aa, Homo sapiens; identical to SEQ ID NO: 895806

SEQ ID NO: 895817 - protein, 216 aa, Homo sapiens; identical to SEQ ID NO: 895806

SEQ ID NO: 895818 - protein, 216 aa, Homo sapiens; identical to SEQ ID NO: 895806

SEQ ID NO: 895819 - protein, 216 aa, Homo sapiens; identical to SEQ ID NO: 895806

SEQ ID NO: 895820 - protein, 216 aa, Homo sapiens; identical to SEQ ID NO: 895806

SEQ ID NO: 895821 - protein, 151 aa, Homo sapiens
MYKHALVKGVNLVRQVDEKVVMARSDSQALTLRDVRFVTSNVGSLEGYAVSMDKWYSSITRGLRSTYEEDSELLLQIRNDVLDSLGISPDLLPEDFVRYCFSEMAPVCAVVGGILAQEIVKALSQRDPPHNNFFFFDGMKGNGIVECLGPK

SEQ ID NO: 895822 - protein, 216 aa, Homo sapiens; identical to SEQ ID NO: 895806

SEQ ID NO: 895823 - protein, 175 aa, Homo sapiens; identical to SEQ ID NO: 895815

SEQ ID NO: 895824 - protein, 216 aa, Homo sapiens; identical to SEQ ID NO: 895806

SEQ ID NO: 895825 - protein, 139 aa, Homo sapiens
LQLGTRPGVKFGRGAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPG

SEQ ID NO: 895826 - protein, 216 aa, Homo sapiens; identical to SEQ ID NO: 895806

SEQ ID NO: 895827 - protein, 216 aa, Homo sapiens; identical to SEQ ID NO: 895806

SEQ ID NO: 895828 - protein, 216 aa, Homo sapiens; identical to SEQ ID NO: 895806

SEQ ID NO: 895829 - protein, 216 aa, Homo sapiens; identical to SEQ ID NO: 895806

SEQ ID NO: 895830 - protein, 205 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVTSRVAGTTGARHHARLIFLYF

SEQ ID NO: 895831 - protein, 204 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVADGNGLSQSAPFFCPPHVTEMLL

SEQ ID NO: 895832 - protein, 285 aa, Homo sapiens
MLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKVGLLAWFKKALVVGLGAVGKGKGGLERARTVGENISAQRGALKSGQIKGRSPTAGNKERGDNIEGGGPITNNAGWDAHSGERYMKQNRYKTEASKSIARHATIGRGENQSKQKSTDEGKTNNDITWTATTKKDGHNRATE

SEQ ID NO: 895833 - protein, 501 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKSENENQEQIEESKEQQEPSSGGSVVPTVQEPKDVLEKKKD

SEQ ID NO: 895834 - protein, 299 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDAFILDSESTCAGCYMGVLDDAEVWGTNDPVTQVISIVPNR

SEQ ID NO: 895835 - protein, 175 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLRFPGGLKIGVWPFFIGEIKRGLGI

SEQ ID NO: 895836 - protein, 175 aa, Homo sapiens; identical to SEQ ID NO: 895835

SEQ ID NO: 895837 - protein, 136 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSN

SEQ ID NO: 895838 - protein, 157 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMSIASEFGVRGYPTIKLRFPGGLKIGVWPFFIGEIKRGLGI

SEQ ID NO: 895839 - protein, 170 aa, Homo sapiens
MIHRHLQLSLEISNKLKSELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKSENENQEQIEESKEQQEPSSGGSVVPTVQEPKDVLEKKKD

SEQ ID NO: 895840 - protein, 501 aa, Homo sapiens; identical to SEQ ID NO: 895833

SEQ ID NO: 895841 - protein, 501 aa, Homo sapiens; identical to SEQ ID NO: 895833

SEQ ID NO: 895842 - protein, 74 aa, Homo sapiens
SCPYPFDTVRRRMMKQSGRKGADIMYTGTDRLFRRKIFRDEGGKAFFKGAWSNVLRGKGGAFVLVLYDELKKVN

SEQ ID NO: 895843 - protein, 299 aa, Homo sapiens; identical to SEQ ID NO: 895834

SEQ ID NO: 895844 - protein, 242 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEVIFKI

SEQ ID NO: 895845 - protein, 271 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDGKFQIFNSCKTF

SEQ ID NO: 895846 - protein, 252 aa, Homo sapiens
SPAPVVSAVLLFRSGSAPFPFPGGQAADPSVFIPLLHSQLLQLSRASMAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKVRLFFNPQKQMYCNLIYSIIKTSLETQNLLLCTYWKYFHSF

SEQ ID NO: 895847 - protein, 177 aa, Homo sapiens
WYVPRSAGPKMAASVCSGLLGPRVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 895848 - protein, 203 aa, Homo sapiens
GTSRARLGPRWRPPCAAGCWGHGEWGDSAGPCESEVGSLVSASRALPPQVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 895849 - protein, 121 aa, Homo sapiens
RFWMLTLELWQGPGAMRLIFYYALPSSGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 895850 - protein, 113 aa, Homo sapiens
RPRGGSEGGGSGDLAALMASPGHSDLGEVAPEIKASERRTAVAIADLEWREMEGDDCEFRYGDGTNEAQDNDFPTDQDTGPRASKQPAKGHTLGRSVFFVFFPLPFTTMLLKK

SEQ ID NO: 895851 - protein, 856 aa, Homo sapiens
MLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895852 - protein, 155 aa, Homo sapiens
TGGTWREVGVWIGDLVESRPLLLQNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 895853 - protein, 177 aa, Homo sapiens; identical to SEQ ID NO: 895847

SEQ ID NO: 895854 - protein, 139 aa, Homo sapiens
MMLGTEGGEGFVVKVRGLPGLARPMKCRGFFLTAKFKMGLKVFVSSTPEKADQVARLLLNLNQKMKFMWGTFPGCLADQLVLKRRGNQLEICAVVLRQLSPHKYYFLVGYSETLLSYFYKCPVRLHLQTVPSKVVYKYL

SEQ ID NO: 895855 - protein, 84 aa, Homo sapiens
AARAWGAGGGAGGGQRSPGMRGSGYAGLGDPGRARGPEVPGARRERGPGERLGNRGAGPRRGPGQPAEAWKCFAPAPGIDVPGF

SEQ ID NO: 895856 - protein, 86 aa, Homo sapiens
SPRAERPGAAEGKQRGCPGYAGHPHLVLWLRPLVSKAPERPAKRRGSLALRRRAEHPQGATRSPAPCSYILGVFPGCHITPENSGS

SEQ ID NO: 895857 - protein, 948 aa, Homo sapiens
RPRGGSEGGGSGDLAALMASPGIEVELLGKGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895858 - protein, 888 aa, Homo sapiens
MEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895859 - protein, 948 aa, Homo sapiens
WLQPPRLRRSYHLSLLSSWDYRIEVELLGKGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895860 - protein, 935 aa, Homo sapiens
MRGSTHASGLAALMASPGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895861 - protein, 827 aa, Homo sapiens
YWWCSQPLWPEPLGVEHFLREMGQLYEAESCPEEAGRLPAGQKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895862 - protein, 424 aa, Homo sapiens
MTLQNHRGLDLLTAEKGGLCTFLGEDCCFYTNQSGILRDATRCLQEKASEIRQHLSNSYTNLLEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 895863 - protein, 167 aa, Homo sapiens
MVQMRLRTMIFQQVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 895864 - protein, 175 aa, Homo sapiens
MIASSVMEMVQMRLRTMIFQQVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 895865 - protein, 948 aa, Homo sapiens; identical to SEQ ID NO: 895857

SEQ ID NO: 895866 - protein, 797 aa, Homo sapiens
RPRGGSEGGGSGDLAALMASPGIEVELLGKGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLWD

SEQ ID NO: 895867 - protein, 203 aa, Homo sapiens; identical to SEQ ID NO: 895848

SEQ ID NO: 895868 - protein, 84 aa, Homo sapiens; identical to SEQ ID NO: 895855

SEQ ID NO: 895869 - protein, 175 aa, Homo sapiens
WYVPRSAGPKMAASVCSGLLGPRVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHNTSRTIPFFPSSCSLQRMETWERNGMWGKCIPSED

SEQ ID NO: 895870 - protein, 84 aa, Homo sapiens; identical to SEQ ID NO: 895855

SEQ ID NO: 895871 - protein, 311 aa, Homo sapiens
RRAFPAAPGLATRTGECDCVSGSMAEKRHTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 895872 - protein, 311 aa, Homo sapiens; identical to SEQ ID NO: 895871

SEQ ID NO: 895873 - protein, 182 aa, Homo sapiens
QLQANSTINATFSNSRPAFLTPMKNDQFKKHRSQVSSQAVSERCYRSRLPCPNNSKATLPPASSRIALERDQSDITDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 895874 - protein, 405 aa, Homo sapiens
RRAFPAAPGLATRTGECDCVSGSMAEKRHTRDSEAQRLPDSFKDSPSKGLGPCGWILVAFSFLFTVITFPISIWMCIKHHKQFINKQSLHKQPIPSYSISGQPFTQCAGSPKAPRGLFLIIHCPCDLHQLSIQQVRTMQHTHFQYCIISISPGKHPSTTSAFPCGTTYQQSRIGWWIIFTCCSRIAHPCACRAPLIHQSARPQATPDLLLRTKLTTRATLVLGATNSNRFYRILLLDHDEAHTCTQTMPVSLLRIDRHLHALGAHHTVDAVLHTHRDCDNNLVPGSRRAMGWPRKQTARPSEGQSPMGYRSTNGSTSTAFQRALERSFPKGQFSWNLTLDAHVQTPKHGNTGQPIDGCDTTPPRLVTLVPMKSAQEDNIGERQRHRPTDSADATSQHRMATMHGH

SEQ ID NO: 895875 - protein, 71 aa, Homo sapiens
WRGPEGLLFVSAGLRHRREVVGKDPIFGGEHFMLEETDWYLLNLFRLWWHYGISFLRLQMWVEELMEKFMR

SEQ ID NO: 895876 - protein, 311 aa, Homo sapiens; identical to SEQ ID NO: 895871

SEQ ID NO: 895877 - protein, 233 aa, Homo sapiens
MDFGGVLILIHRYNFPNLNMDVHKGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVIAAEGEMNASRALKEASMVITESPAALQLRYLQTLTTIAAEKNSTIVFPLPIDMLQGIIGAKHSHLG

SEQ ID NO: 895878 - protein, 146 aa, Homo sapiens
RRAFPAAPGLATRTGECDCVSGSMAEKRHTRDSEAQRLPDSFKDSPSKGLGPCGWILVAFSFLFTVITFPISIWMCIKVIAAEGEMNASRALKEASMVITESPAALQLRYLQTLTTIAAEKNSTIVFPLPIDMLQGIIGAKHSHLG

SEQ ID NO: 895879 - protein, 220 aa, Homo sapiens
RRAFPAAPGLATRTGECDCVSGSMAEKRHTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDK

SEQ ID NO: 895880 - protein, 311 aa, Homo sapiens; identical to SEQ ID NO: 895871

SEQ ID NO: 895881 - protein, 311 aa, Homo sapiens; identical to SEQ ID NO: 895871

SEQ ID NO: 895882 - protein, 311 aa, Homo sapiens; identical to SEQ ID NO: 895871

SEQ ID NO: 895883 - protein, 311 aa, Homo sapiens; identical to SEQ ID NO: 895871

SEQ ID NO: 895884 - protein, 311 aa, Homo sapiens; identical to SEQ ID NO: 895871

SEQ ID NO: 895885 - protein, 311 aa, Homo sapiens; identical to SEQ ID NO: 895871

SEQ ID NO: 895886 - protein, 311 aa, Homo sapiens; identical to SEQ ID NO: 895871

SEQ ID NO: 895887 - protein, 311 aa, Homo sapiens; identical to SEQ ID NO: 895871

SEQ ID NO: 895888 - protein, 146 aa, Homo sapiens; identical to SEQ ID NO: 895878

SEQ ID NO: 895889 - protein, 259 aa, Homo sapiens
RRAFPAAPGLATRTGECDCVSGSMAEKRHTRDSEAQRLPDSFKDSPSKGLGPCGWILVAFSFLFTVITFPISIWMCIKIIKEYERAIIFRLGRILQGGAKGPGLFFILPCTDSFIKVDMRTISFDIPPQEILTKDSVTISVDGVVYYRVQNATLAVANITNADSATRLLAQTTLRNVLGTKNLSQILSDREEIAHNMQSTLDDATDAWGIKVERVEIKDVKLPVQLQRAMAAEAEASREARAKVTFFLNLFFLLSFLFY

SEQ ID NO: 895890 - protein, 131 aa, Homo sapiens
MDFGGVLILIHRYNFPNLNMDVHKGLFFILPCTDSFIKVDMRTISFDIPPQEILTKDSVTISVDGVVYYRVQNATLAVANITNADSATRLLAQTTLRNVLGTKNLSQILSDREEIAHNMQHVLTYLSLLYE

SEQ ID NO: 895891 - protein, 67 aa, Homo sapiens
LSSCLARSGQQCLGRASEAHTRIARGRTSSLRLGLGAAPRLQPRKRILTFPRLPVPGGAGLRSSSLS

SEQ ID NO: 895892 - protein, 67 aa, Homo sapiens; identical to SEQ ID NO: 895891

SEQ ID NO: 895893 - protein, 67 aa, Homo sapiens; identical to SEQ ID NO: 895891

SEQ ID NO: 895894 - protein, 67 aa, Homo sapiens; identical to SEQ ID NO: 895891

SEQ ID NO: 895895 - protein, 67 aa, Homo sapiens; identical to SEQ ID NO: 895891

SEQ ID NO: 895896 - protein, 90 aa, Homo sapiens
MPKRKAKGDAKGDKAKVKDEPQRRSARLSAKPAPPKPEPRPKKASAKKGEKLPKGRKGKADAGKDGNNPAKNRDASTLQSQKAEGTGDAK

SEQ ID NO: 895897 - protein, 237 aa, Homo sapiens
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGSPTGGLFNTPPPTPPEQDKEDFSSFQLLVEVALQRAAEMELQKQQDPSLPLLHTPIPLVSENPQ

SEQ ID NO: 895898 - protein, 237 aa, Homo sapiens; identical to SEQ ID NO: 895897

SEQ ID NO: 895899 - protein, 158 aa, Homo sapiens [sequence omitted]

SEQ ID NO: 895900 - protein, 237 aa, Homo sapiens; identical to SEQ ID NO: 895897

SEQ ID NO: 895901 - protein, 101 aa, Homo sapiens
RGVGAARRAPHKVCFLPPGGWGRAQRARGEERGSDVRPRGAFHAASCQAECQAGQVRGARPRRPPLPAGTPRAEPEAAWTRKPLGKVYPRSSLAPRHHVGQ

SEQ ID NO: 895902 - protein, 237 aa, Homo sapiens; identical to SEQ ID NO: 895897

SEQ ID NO: 895903 - protein, 375 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895904 - protein, 91 aa, Homo sapiens
VLRSPYGASVSDGKVSLMEKVSGMQSVSVMQSVSGCKVSLDAKASGCKVSLDAKCLWMQSVSGCKESLDAKCPLDAKCPLDAKCPLDAKCL

SEQ ID NO: 895905 - protein, 459 aa, Homo sapiens
NSPFTVALLLKFFPPRESLDGGGGAGGKPPLGTERCGPGYGRRQLSGQVSRGKGSIIQGGRPVLPAGVGGPRRPAFFPHAGVHSMSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895906 - protein, 375 aa, Homo sapiens; identical to SEQ ID NO: 895903

SEQ ID NO: 895907 - protein, 399 aa, Homo sapiens
GRGDVKLSRLLPLRSALASLIVHSMSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895908 - protein, 341 aa, Homo sapiens
MSASAPAAEGEGTPTQPASEKEPEMPGPREESEEEEDEDDEEEEEEEKGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895909 - protein, 307 aa, Homo sapiens
MSASAPAAEGEGTPTQPASEKEPEMPGPREESEEEEDEDDEEEEEEEKEKSLIVEGKREKKKVERLTMQVSSLHKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895910 - protein, 227 aa, Homo sapiens
IWSPSIGYRRPRPSVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895911 - protein, 139 aa, Homo sapiens
SGDVGVGRGQGEMLRKFQPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 895912 - protein, 375 aa, Homo sapiens; identical to SEQ ID NO: 895903

SEQ ID NO: 895913 - protein, 375 aa, Homo sapiens; identical to SEQ ID NO: 895903

SEQ ID NO: 895914 - protein, 375 aa, Homo sapiens; identical to SEQ ID NO: 895903

SEQ ID NO: 895915 - protein, 375 aa, Homo sapiens; identical to SEQ ID NO: 895903

SEQ ID NO: 895916 - protein, 375 aa, Homo sapiens; identical to SEQ ID NO: 895903

SEQ ID NO: 895917 - protein, 375 aa, Homo sapiens; identical to SEQ ID NO: 895903

SEQ ID NO: 895918 - protein, 375 aa, Homo sapiens; identical to SEQ ID NO: 895903

SEQ ID NO: 895919 - protein, 375 aa, Homo sapiens; identical to SEQ ID NO: 895903

SEQ ID NO: 895920 - protein, 375 aa, Homo sapiens; identical to SEQ ID NO: 895903

SEQ ID NO: 895921 - protein, 375 aa, Homo sapiens; identical to SEQ ID NO: 895903

SEQ ID NO: 895922 - protein, 375 aa, Homo sapiens; identical to SEQ ID NO: 895903

SEQ ID NO: 895923 - protein, 375 aa, Homo sapiens; identical to SEQ ID NO: 895903

SEQ ID NO: 895924 - protein, 375 aa, Homo sapiens; identical to SEQ ID NO: 895903

SEQ ID NO: 895925 - protein, 91 aa, Homo sapiens; identical to SEQ ID NO: 895904

SEQ ID NO: 895926 - protein, 375 aa, Homo sapiens; identical to SEQ ID NO: 895903

SEQ ID NO: 895927 - protein, 375 aa, Homo sapiens; identical to SEQ ID NO: 895903

SEQ ID NO: 895928 - protein, 380 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKEVNISVFQV

SEQ ID NO: 895929 - protein, 383 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKKKSLIVEGKREKKKVERLTMQVSSLQREPFTIAQ

SEQ ID NO: 895930 - protein, 303 aa, Homo sapiens
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESES

SEQ ID NO: 895931 - protein, 638 aa, Homo sapiens
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895932 - protein, 688 aa, Homo sapiens
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895933 - protein, 195 aa, Homo sapiens
MTTQSSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPPSL

SEQ ID NO: 895934 - protein, 701 aa, Homo sapiens
AVNRYQGHSRSRGSPSSSYHEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895935 - protein, 365 aa, Homo sapiens
CGGVSSATPGVYIRNHPNLVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895936 - protein, 688 aa, Homo sapiens; identical to SEQ ID NO: 895932

SEQ ID NO: 895937 - protein, 688 aa, Homo sapiens; identical to SEQ ID NO: 895932

SEQ ID NO: 895938 - protein, 567 aa, Homo sapiens
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSYCPGWSSSSAAGPQVT

SEQ ID NO: 895939 - protein, 538 aa, Homo sapiens
MTTQSSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895940 - protein, 365 aa, Homo sapiens
PSLFHPSSYCFSSPNRGDSVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895941 - protein, 186 aa, Homo sapiens
GHDTTRVSDPGVVQRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 895942 - protein, 401 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 895943 - protein, 401 aa, Homo sapiens; identical to SEQ ID NO: 895942

SEQ ID NO: 895944 - protein, 401 aa, Homo sapiens; identical to SEQ ID NO: 895942

SEQ ID NO: 895945 - protein, 318 aa, Homo sapiens [sequence omitted]

SEQ ID NO: 895946 - protein, 368 aa, Homo sapiens [sequence omitted]

SEQ ID NO: 895947 - protein, 401 aa, Homo sapiens; identical to SEQ ID NO: 895942

SEQ ID NO: 895948 - protein, 401 aa, Homo sapiens; identical to SEQ ID NO: 895942

SEQ ID NO: 895949 - protein, 410 aa, Homo sapiens
YFLLSFQLPMSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 895950 - protein, 367 aa, Homo sapiens
KAPAQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 895951 - protein, 318 aa, Homo sapiens [sequence omitted]

SEQ ID NO: 895952 - protein, 382 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRIPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 895953 - protein, 401 aa, Homo sapiens; identical to SEQ ID NO: 895942

SEQ ID NO: 895954 - protein, 168 aa, Homo sapiens [sequence omitted]

SEQ ID NO: 895955 - protein, 368 aa, Homo sapiens [sequence omitted]

SEQ ID NO: 895956 - protein, 351 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEVDEVTAWIQRLLVNKEVRAR

SEQ ID NO: 895957 - protein, 318 aa, Homo sapiens [sequence omitted]

SEQ ID NO: 895958 - protein, 171 aa, Homo sapiens [sequence omitted]

SEQ ID NO: 895959 - protein, 539 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELESTHRQHQHSNRATHTGVNSTAPCTAQAGSIAKAAPSIQAFMQCTGMQSISLPAQQQRGQHSKSSGRAACHICTHTHTFLWVSQPQAQQAASPPSRHYLPSLRKARHITTTLRIHEIRFTKPAQPTLPIPHRMVPNGTPKDQRTPQQSSTHPGEPYSAKHFPLSPYGHTTKRGETPTREPRPATNRNSNWRTNTITRGTFPRGQAATKGDSIAQEDTGTFGTAQAGQLTGQPLGPLDHKDRGHAHRTTTQQTVAQGSKKHNKASRDQNTDHTHEKRTKRTGQNHPTEKDVTQHIQNDYTKRTIAANRHGVAPTPPTGGPTTPQRTTRGRDARTPRSQVHNTRADADTAGTAGEPTTRTTDEQRTLRPSQADVLEAQPAETQAHQAHHLDTRHDRQHTANKPREQHERATNDRTT

SEQ ID NO: 895960 - protein, 246 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTDEEYLQAYGGQQGLQEQEDCVAEDELDEITDAQVAPATEEGGMETLELYKGPSCRLV

SEQ ID NO: 895961 - protein, 1024 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVILPEEELMSDLMPSDDISCWTLLPKASREPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGVS

SEQ ID NO: 895962 - protein, 592 aa, Homo sapiens
SVALGSSRDCVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGVS

SEQ ID NO: 895963 - protein, 193 aa, Homo sapiens
RRSPESTYGQQSSPPCFKHLGFRSRAEVTAACLRCTPTARNTAAASGLLRPRRGQAPAPARLPASIIPGCTAAGAGARPCCGSLLFSSCGGEGPAVDREAPGFASASCSPLPSLSSVTRTRARTRHVGPPAGLVGEAEGRAPRVPWRPPWERAEEQAPEMMTLTSLISLARNGRGEEELLMRTGTGTCTLCFT

SEQ ID NO: 895964 - protein, 268 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLGNFFACLPSSFTLISTSSIVLL

SEQ ID NO: 895965 - protein, 613 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVILPEEELMSDLMPSDDISCWTLLPKASREPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQVMHPE

SEQ ID NO: 895966 - protein, 995 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAALLEFEERERQHKQGRYSSRRGGRRGGPLMCRGVGDQRRESTERGRMKDHRPALLPTQPPVVPQAPPPPPPPPQQQPIRSLFQPQPLQPLLPVQHPHHPSPPQGMHMPPQLETPRMMMTPPPVTPQQPKNIHINPHFKGTVVTPVQVPLLPVPSQPRPAVGPQRFPGPPEFPQHTPGPVPNSFSQPPRLPLQDQWRAPPPPQDRDPFFLGVSGEPRFPSHLFLEQRSPPPPPPPPTLLNSSHPVPTQSPLPFTQPGPAFNQQGQQPVFPRERPVRPALQPPGPVGILHFSQPGSATTRPFIPPRQPFLPGPGQPFLPTHTQPNLQGPLHPPLPPPHQPQPQQPQQQPPPQHQPPHQPPHQPPPQHQPPPQHPPQHPPQHQHHHHHHHLSVPPPPLMPMSQPQFRPHVQTAQPQASSSRMQCPQRQGLRHNTTSQNVSKRPMQQMQPTAPRNSNLRELPIAPSHVIEMSSSRCSATPSAQVKPIVSASPPSRAVAGSRSSQGKTEVKVKPASPVAQPKEEAKTETEFPDEDEETRLYRLKIEEQKRLREEILKQKELRRQQQAGARKKELLERLAQQQQQLYAPPPPAEQEEQALSPSPTNGNPLLPFPGAQVRQNVKNRLLVKNQDVSISNVQPKTSNFVPSSANMQYQGQQMKALKHLRQTRTVPQSQTQPLHKVLPIKPADVEEPAVPQTPRVASIQGRPQDTKPGVKRTVTHRTNSGGGDGPHISSKVRVIKLSGGVS

SEQ ID NO: 895967 - protein, 362 aa, Homo sapiens
QKLGRLRAQRGLPGDAGPLPARSPQVGPAPGRWGAARCPQVAASSRPPSAASPDRGRTSPRACSPGAPLRTPGPSQVCARGPSRPCGERGPERRRGLRAPETEGLAAEGTAPRRASGPGAAGTCAGGHSLFDSCQTMFTLLVLLSQLPTVTLGFPHCARGPKASKHAGEEVFTSKEEANFFIHRRLLYNRFDLELFTPGNLERECNEELCNYEEAREIFVDEDKTIAFWQEYSAKGPTTKSDGNREKIDVMGLLTGLIAAGVFLVIFGLLGYYLCITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 895968 - protein, 362 aa, Homo sapiens; identical to SEQ ID NO: 895967

SEQ ID NO: 895969 - protein, 760 aa, Homo sapiens
QSGLALGYWLGPMLGTLRAMEGEDVEDDQLLQKLRASRRRFQRRMQRLIEKYNQPFEDTPVVQMATLTYETPQGLRIWGGRLIKERNKGEIQDSSMKPADRTDGSVQAAAWGPELPSHRTVLGADSKSGEVDATSDQEESVAWALAPAVPQSPLKNELRRKYLTQVDILLQGAEYFECAGNRAGRDVRVTPLPSLASPAVPAPGYCSRISGKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 895970 - protein, 727 aa, Homo sapiens
VRVGAWVLAGSDAGYAARHGGRGRGRRPAAAEAQGQSPPLPEAHAAADREVQPALRGHPGGANGHADLRDATGIENLGWKTNKGKKQRRDPDSKSGEVDATSDQEESVAWALAPAVPQSPLKNELRRKYLTQVDILLQGAEYFECAGNRAGRDVRVTPLPSLASPAVPAPGYCSRISGKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 895971 - protein, 524 aa, Homo sapiens [sequence omitted]

SEQ ID NO: 895972 - protein, 760 aa, Homo sapiens; identical to SEQ ID NO: 895969

SEQ ID NO: 895973 - protein, 760 aa, Homo sapiens; identical to SEQ ID NO: 895969

SEQ ID NO: 895974 - protein, 444 aa, Homo sapiens
QSGLALGYWLGPMLGTLRAMEGEDVEDDQLLQKLRASRRRFQRRMQRLIEKYNQPFEDTPVVQMATLTYETPQGLRIWGGRLIKERNKGEIQDSSMKPADRTDGSVQAAAWGPELPSHRTVLGADSKSGEVDATSDQEESVAWALAPAVPQSPLKNELRRKYLTQVDILLQGAEYFECAGNRAGRDVRVTPLPSLASPAVPAPGYCSRISGKSPGDPAKPASSPREWDPLHPSSTDMALVPRNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 895975 - protein, 260 aa, Homo sapiens
MGGVERHRLLVVPAEHAHLQLGLQQPGGRRPGGRVQPGLGRPRRGPLLARRRLAGGGGGGGGGGRAAQQHGGGTTRERAQLGEALLQQPGLGGARAQLQRAQFQRAPQVAAPGPRLVAVVVVVLVVVGRPQRRPQRPRPGPRVGGAAGRRGGGGRGAAAAVPTAGAAEARLAVHRFGDERGEPQVVVPGAEGLRVRRARGAHVAGAGHERHGRGGAAAAGRAGRPGESLHGRAAGRAPPPRRRRGPDGRDTPSLPAGLPR

SEQ ID NO: 895976 - protein, 260 aa, Homo sapiens; identical to SEQ ID NO: 895975

SEQ ID NO: 895977 - protein, 260 aa, Homo sapiens; identical to SEQ ID NO: 895975

SEQ ID NO: 895978 - protein, 1063 aa, Homo sapiens [sequence omitted]

SEQ ID NO: 895979 - protein, 1050 aa, Homo sapiens
PAAAHAPAGAPPPCAARLQGHVPGSGLVDSSVPAAAGRPGIAAGPPEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTPPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 895980 - protein, 1120 aa, Homo sapiens
PAAAHAPAGAPPPCAARLQGHVPGSGLVDSSVPAAAGRPGIAAGPPEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 895981 - protein, 1096 aa, Homo sapiens
PAAAHAPAGAPPPCAARLQGHVPGSGLVDSSVPAAAGRPGIAAGPPEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPRPCSFLPPVTFGNGQRPSAVLGGPHGHVGDPAHRAAALQQGASSSHGSGQAGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 895982 - protein, 1120 aa, Homo sapiens; identical to SEQ ID NO: 895980

SEQ ID NO: 895983 - protein, 1007 aa, Homo sapiens
PAAAHAPAGAPPPCAARLQGHVPGSGLVDSSVPAAAGRPGIAAGPPEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLDPEL

SEQ ID NO: 895984 - protein, 769 aa, Homo sapiens
PAAAHAPAGAPPPCAARLQGHVPGSGLVDSSVPAAAGRPGIAAGPPEQISAPFQTLLMPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPRPCSFLPPVTFGNGQRPSAVLGGPHGHVGDPAHRAAALQQGASSSHGSGQAGPEDEQVPGECAGPKRHHQWGGDAVAAGKAEKRKFGPCRAGHCGCSTVFLPLRPVFEDKQICQLSGCSGTSETMWSIAFIV

SEQ ID NO: 895985 - protein, 112 aa, Homo sapiens
MQDTGSVVPLHWFGFGYAALVASGGIIGYVKAGSVPSLAAGLLFGSLAGLGAYQLSQDPRNVWVFLATSGTLAGIMGMRFYHSGKFMPAGLIAGASLLMVAKVGVSMFNRPH

SEQ ID NO: 895986 - protein, 89 aa, Homo sapiens
LDSGARRDAPPHSPPAECRAHAATWRLKPRPHRPHSLTAPLPVHCAGTTEPLPSPRPATGTESARRCISGDTSQSFLRLARPCRQPGPS

SEQ ID NO: 895987 - protein, 112 aa, Homo sapiens; identical to SEQ ID NO: 895985

SEQ ID NO: 895988 - protein, 112 aa, Homo sapiens; identical to SEQ ID NO: 895985

SEQ ID NO: 895989 - protein, 112 aa, Homo sapiens; identical to SEQ ID NO: 895985

SEQ ID NO: 895990 - protein, 89 aa, Homo sapiens; identical to SEQ ID NO: 895986

SEQ ID NO: 895991 - protein, 89 aa, Homo sapiens; identical to SEQ ID NO: 895986

SEQ ID NO: 895992 - protein, 112 aa, Homo sapiens; identical to SEQ ID NO: 895985

SEQ ID NO: 895993 - protein, 112 aa, Homo sapiens; identical to SEQ ID NO: 895985

SEQ ID NO: 895994 - protein, 89 aa, Homo sapiens; identical to SEQ ID NO: 895986

SEQ ID NO: 895995 - protein, 112 aa, Homo sapiens; identical to SEQ ID NO: 895985

SEQ ID NO: 895996 - protein, 160 aa, Homo sapiens
MQDTGSVVPLHWFGFGYAALVASGGIIGYVKAGSVPSLAAGLLFGSLAGLGAYQLSQDPRNVWVFLALHPVPLALGEGGPTTPENPRPAQSAPVRRRPPKWSARPAAPRRSHAPATDEELKICIFHYFQYIKRNKCSIFASDILPKKKDTKLGREVENQS

SEQ ID NO: 895997 - protein, 112 aa, Homo sapiens; identical to SEQ ID NO: 895985

SEQ ID NO: 895998 - protein, 112 aa, Homo sapiens; identical to SEQ ID NO: 895985

SEQ ID NO: 895999 - protein, 112 aa, Homo sapiens; identical to SEQ ID NO: 895985

SEQ ID NO: 896000 - protein, 1004 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATQKLRPASQQGVQMKTQGGASNPALQIGSHPMCKSSQFKSDQSNPSTVKHSQPKPFHSVPSQPKSSQTKSCQSQPSQTKPWFLHVGQAGLELPTSGDPPT

SEQ ID NO: 896001 - protein, 943 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATHNAIKFDCFKQIRFQLSSNPLVNTRIIVFSVFRDQGLT

SEQ ID NO: 896002 - protein, 1037 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATQKLRPASQQGVQMKTQGGASNPALQIGSHPMCKSSQFKSDQSNPSTVKHSQPKPFHSVPSQPKSSQTKSCQSQPSQTKPSPCKSTQPKPSQPWPPQSKPSQPRPPQPKSSSTNPSQAKAHHSKAGQKRGGKH

SEQ ID NO: 896003 - protein, 1021 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATQKLRPASQQGVQMKTQGGASNPALQIGSHPMCKSSQFKSDQSNPSTVKHSQPKPFHSVPSQPKSSQTKSCQSQPSQTKPSPCKSTQPKPSQPWPPQSKASGSISATEQITLLIWCG

SEQ ID NO: 896004 - protein, 941 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATHTYTHTHAEETDLLGFKTLQYLRHTDDPQSTGPGLL

SEQ ID NO: 896005 - protein, 187 aa, Homo sapiens
EKPTETEPLSTLQLSSADRLPPPPPPDSGGEERKAENMDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPCAVDVYPCIVETSEPQEQTGE

SEQ ID NO: 896006 - protein, 187 aa, Homo sapiens; identical to SEQ ID NO: 896005

SEQ ID NO: 896007 - protein, 212 aa, Homo sapiens
MLECSGTISAHCNLHLPCSSDFFCLSLLSSWDCRCVPPHLANFSIFYRDGGDSGGEERKAENMDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPCAVDVYPCIVETSEPQEQTGE

SEQ ID NO: 896008 - protein, 107 aa, Homo sapiens
HRARSGVIDAPLSPFATSIAELVTPHFFFLIFQVFLSPFNMILGGIVVVLVFTGFVWAAHNKDVLRRMKKRYPTTFVMVVMLASYFLISMFGGVMVFVFGITFPCAV

SEQ ID NO: 896009 - protein, 187 aa, Homo sapiens; identical to SEQ ID NO: 896005

SEQ ID NO: 896010 - protein, 187 aa, Homo sapiens; identical to SEQ ID NO: 896005

SEQ ID NO: 896011 - protein, 187 aa, Homo sapiens; identical to SEQ ID NO: 896005

SEQ ID NO: 896012 - protein, 187 aa, Homo sapiens; identical to SEQ ID NO: 896005

SEQ ID NO: 896013 - protein, 212 aa, Homo sapiens; identical to SEQ ID NO: 896007

SEQ ID NO: 896014 - protein, 187 aa, Homo sapiens; identical to SEQ ID NO: 896005

SEQ ID NO: 896015 - protein, 187 aa, Homo sapiens; identical to SEQ ID NO: 896005

SEQ ID NO: 896016 - protein, 187 aa, Homo sapiens; identical to SEQ ID NO: 896005

SEQ ID NO: 896017 - protein, 187 aa, Homo sapiens; identical to SEQ ID NO: 896005

SEQ ID NO: 896018 - protein, 150 aa, Homo sapiens
MDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPCAVDVYPCIVETSEPQEQTGE

SEQ ID NO: 896019 - protein, 187 aa, Homo sapiens; identical to SEQ ID NO: 896005

SEQ ID NO: 896020 - protein, 205 aa, Homo sapiens
GCAYARHVALGAGDGRPESAITLEAMSANSLDYSYRSIPVCSSGTELSCACFYPELTYKRRGGTYPEALLHTMSTDATYWKATLVAVIYSTREVTHRLSRAESLLECIVPLLSGFLSPFNMILGGIVVVLVFTGFVWAAHNKDVLRRMKKRYPTTFVMVVMLASYFLISMFGGVMVFVFGITFPCAVDVYPCIVETSEPQEQTGE

SEQ ID NO: 896021 - protein, 178 aa, Homo sapiens
MNDTLGTVDVNICPHSLLSMGMDLYRTSASADLQLAAGDTPADIIQDMEATRGYVERNMIPIQRQYLDVTMDGGLIMHGFPCRAIMEFLSPFNMILGGIVVVLVFTGFVWAAHNKDVLRRMKKRYPTTFVMVVMLASYFLISMFGGVMVFVFGITFPCAVDVYPCIVETSEPQEQTGE

SEQ ID NO: 896022 - protein, 155 aa, Homo sapiens
MLECSGTISAHCNLHLPCSSDFFCLSLLSSWDCRCVPPHLANFSIFYRDGGDSGGEERKAENMDVNIAPLRAWDDFFPGSDRFARPDFRDISKWNNRVVSNLLYYQTNYLVVAAMMISIVGLECNGVISAHCNLHLLSSSDSPASASQVAGITGF

SEQ ID NO: 896023 - protein, 103 aa, Homo sapiens
FPEKPLTVIYCPFLSPFNMILGGIVVVLVFTGFVWAAHNKDVLRRMKKRYPTTFVMVVMLASYFLISMFGGVMVFVFGITFPCAVDVYPCIVETSEPQEQTGE

SEQ ID NO: 896024 - protein, 82 aa, Homo sapiens
LFPFFFWLSTGFVWAAHNKDVLRRMKKRYPTTFVMVVMLASYFLISMFGGVMVFVFGITFPCAVDVYPCIVETSEPQEQTGE

SEQ ID NO: 896025 - protein, 205 aa, Homo sapiens
EKPTETEPLSTLQLSSADRLPPPPPPDSGGEERKAENMDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPCAVDVYPCIVETSEPQEQTGESRTAGTKASTDSLTISAK

SEQ ID NO: 896026 - protein, 139 aa, Homo sapiens
MLECSGTISAHCNLHLPCSSDFFCLSLLSSWDCRCVPPHLANFSIFYRDGGDSGGEERKAENMDVNIAPLRAWDDFFPGSDRFARPDFRDISKWNNRVVSNLLYYQTNYLVVAAMMISIVGDVYPCIVETSEPQEQTGE

SEQ ID NO: 896027 - protein, 182 aa, Homo sapiens
IRGRVDARRRQKGNMDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPCAVDVYPCIVETSEPQEQTGESRTAGTKASTDSLTISAK

SEQ ID NO: 896028 - protein, 187 aa, Homo sapiens; identical to SEQ ID NO: 896005

SEQ ID NO: 896029 - protein, 187 aa, Homo sapiens; identical to SEQ ID NO: 896005

SEQ ID NO: 896030 - protein, 153 aa, Homo sapiens
EKPTETEPLSTLQLSSADRLPPPPPPDSGGEERKAENMDVNIAPLRAWDDFFPGSDRFARPDFRDISKWNNRVVSNLLYYQTNYLVVAAMMISIVGFLSPFNMILGGIVVVLVFTELVGMWCTWAWWSQPCQGGFECTRPSLPQALTCLCFPK

SEQ ID NO: 896031 - protein, 564 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 896032 - protein, 484 aa, Homo sapiens
MNSHVLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 896033 - protein, 583 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPKQGQMELSFPGFKGFPFGSSSRKKITVVKPINRVSQQGGTQGLRNWEPRPRFRVFPNQRKNQLSLKWN

SEQ ID NO: 896034 - protein, 106 aa, Homo sapiens
LDQNVSHNRSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 896035 - protein, 564 aa, Homo sapiens; identical to SEQ ID NO: 896031

SEQ ID NO: 896036 - protein, 530 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNFPFPLTASGKNSYL

SEQ ID NO: 896037 - protein, 518 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNLK

SEQ ID NO: 896038 - protein, 136 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLVST

SEQ ID NO: 896039 - protein, 564 aa, Homo sapiens; identical to SEQ ID NO: 896031

SEQ ID NO: 896040 - protein, 531 aa, Homo sapiens
TLQLANGVSDSDVLELPFSRPYSSSDRNRYVSASLSCGNHGAADSTSLDPGRRRSSFRTVCVYDHCCDEGLAAFPKLMNTGKQHTFVETESVRYVYQPMEKLYMVLITTIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 896041 - protein, 564 aa, Homo sapiens; identical to SEQ ID NO: 896031

SEQ ID NO: 896042 - protein, 540 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVLHFS

SEQ ID NO: 896043 - protein, 316 aa, Homo sapiens
RRGLGPPSWQEAKRQRFLSRGQQVQSCWCSRSPDPTPIPSGAGVRARPTTALTMVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGRRRNSENSKAWKCYRLCHKDYPEKVERGQKAEPNWGFSKAAL

SEQ ID NO: 896044 - protein, 1719 aa, Homo sapiens [sequence omitted]

SEQ ID NO: 896045 - protein, 226 aa, Homo sapiens [sequence omitted]

SEQ ID NO: 896046 - protein, 1707 aa, Homo sapiens
GRGRRGRRNSGGGGGPRCSEALARRARNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 896047 - protein, 1683 aa, Homo sapiens [sequence omitted]

SEQ ID NO: 896048 - protein, 1707 aa, Homo sapiens; identical to SEQ ID NO: 896046

SEQ ID NO: 896049 - protein, 1707 aa, Homo sapiens; identical to SEQ ID NO: 896046

SEQ ID NO: 896050 - protein, 1550 aa, Homo sapiens
RSLCGGPVTRSLQLAAAADLSENQREDGSAKPELKDFRKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 896051 - protein, 1226 aa, Homo sapiens
MNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 896052 - protein, 953 aa, Homo sapiens
GRGRRGRRNSGGGGGPRCSEALARRARNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDDLPPHPGLQQLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 896053 - protein, 287 aa, Homo sapiens
GRGRRGRRNSGGGGGPRCSEALARRARNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEATASAWRPDALHQRPRTSPGSIGRSKLRLQPSSRDHSSKSRHSGCSLTAPEVTWNQ

SEQ ID NO: 896054 - protein, 250 aa, Homo sapiens
GRGRRGRRNSGGGGGPRCSEALARRARNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKATASAWRPDALHQRPRTSPGSIGRSKLRLQPSSRDHSSKSRHSGCSLTGTRQDGTA

SEQ ID NO: 896055 - protein, 268 aa, Homo sapiens
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 896056 - protein, 254 aa, Homo sapiens
RHRNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 896057 - protein, 343 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 896058 - protein, 343 aa, Homo sapiens; identical to SEQ ID NO: 896057

SEQ ID NO: 896059 - protein, 343 aa, Homo sapiens; identical to SEQ ID NO: 896057

SEQ ID NO: 896060 - protein, 343 aa, Homo sapiens; identical to SEQ ID NO: 896057

SEQ ID NO: 896061 - protein, 293 aa, Homo sapiens
GGRRLRGNVSVTLNGETERERGARAHTRTHGPARSEIPGHVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 896062 - protein, 177 aa, Homo sapiens
MMLVVTCLWAPSGAYVFLLSCRTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 896063 - protein, 343 aa, Homo sapiens; identical to SEQ ID NO: 896057

SEQ ID NO: 896064 - protein, 343 aa, Homo sapiens; identical to SEQ ID NO: 896057

SEQ ID NO: 896065 - protein, 171 aa, Homo sapiens [sequence omitted]

SEQ ID NO: 896066 - protein, 343 aa, Homo sapiens; identical to SEQ ID NO: 896057

SEQ ID NO: 896067 - protein, 236 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEESLPLEPGDVSPGFAFDTLCDLGLVLRLFPPSPYQPHISPSVTFCMLYWL

SEQ ID NO: 896068 - protein, 357 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEESECSTHAPLATRPSSSKAATLAERSQSLRTRTSSTQAKGHTPTYHSGSPPGKSLDTTPYISARGRLTDSPLPTKPWPAPAYRSAPRRLSAPPSCARLHSAAMTPPPTCCDALRRADSLAPHPACAGGRAHPFSVAPLTPVPLIQPVIRRSAPSPFPAPPGPPGPPPSPTP

SEQ ID NO: 896069 - protein, 188 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEER

SEQ ID NO: 896070 - protein, 208 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIALPLEPGDVSPGFAFDTLCDLGLVLRLFPPSPYQPHISPSVTFCMLYWL

SEQ ID NO: 896071 - protein, 701 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQGTVHPVTTVSSSDVEKAYLAYCTPGSDGQAATLKFQAGKHNYELDFKAFVQKNLVYGTTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 896072 - protein, 120 aa, Homo sapiens
DCFHSEGDQICLYHIRKSCSFPRKNCRNSHSLTTEHNLSVLRTHGVDHLSYNELCQLLFQNDPWLLPEKFGMWSRRSSEVQGPALPTTQFHKHHTDAMDSCATRADSLTSLSLSVCSIEK

SEQ ID NO: 896073 - protein, 565 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCLEFISICRIDGNSWIEANGRIWTTWKTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 896074 - protein, 337 aa, Homo sapiens
MHMTSRIRALPPAECLLFLSHRGLLKEKTVQVLCPQTLLARRRVIRSVCTISGKVVAFKISAIEFISICRIDGNSWIEANGRIWTTWKTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 896075 - protein, 487 aa, Homo sapiens [sequence omitted]

SEQ ID NO: 896076 - protein, 428 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYISGKVVAFKGTVHPVTTVSSSDVEKAYLAYCTPGSDGQAATLKFQAGKHNYELDFKAFVQKNLVYGTTKKVCRRPKYVSPQDVTTMQTCNTKFPGPKSIPDYWDSSALPDPGFQAKRTDAEAERREGRGRAAAVPRHQRHFCGRHLPAEL

SEQ ID NO: 896077 - protein, 701 aa, Homo sapiens; identical to SEQ ID NO: 896071

SEQ ID NO: 896078 - protein, 231 aa, Homo sapiens [sequence omitted]

SEQ ID NO: 896079 - protein, 235 aa, Homo sapiens
TNGRASSGNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 896080 - protein, 487 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQGTVHPVTTVSSSDVEKAYLAYCTPGSDGQAATLKFQAGKHNYELDFKAFVQKNLVYGTTKKVCRRPKYVSPQDVTTMQTCWTRVGITLWVEAS

SEQ ID NO: 896081 - protein, 474 aa, Homo sapiens [sequence omitted]

SEQ ID NO: 896082 - protein, 206 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEKFGMWSRRSSEVQGPALPTTQFHKHHTDAMDSCATRADSLTSLSLSVCSIEK

SEQ ID NO: 896083 - protein, 124 aa, Homo sapiens
LVFTRSFGKGLIYILHVDGNALKTFAPCRRSPLVLPRKSIRRSGTSLTARCLSTLFRRLSEYRTWPSGKSTSGALGLALGGLVTLSLHTTGWLPHVARVSRKSRAAVRAAMCWELCVCSPSSAP

SEQ ID NO: 896084 - protein, 154 aa, Homo sapiens
MGKSASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEENVLPPKK

SEQ ID NO: 896085 - protein, 169 aa, Homo sapiens
MVRNPALPDLAVSLVRRKPASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEENVLPPKK

SEQ ID NO: 896086 - protein, 128 aa, Homo sapiens
MGKSASKQFHNEVLKAHNEYRQKHGVPPLKLCKNLNREAQQYSEALASTRILKHSPESSRGQCGENLAWASYDQTGHFTAMVWKNTKKMGVGKASASDGSSFVVARYFPAGNVVNEGFFEENVLPPKK

SEQ ID NO: 896087 - protein, 152 aa, Homo sapiens
MGKSASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEDLRTWI

SEQ ID NO: 896088 - protein, 154 aa, Homo sapiens; identical to SEQ ID NO: 896084

SEQ ID NO: 896089 - protein, 143 aa, Homo sapiens
MSLLIRRGPGGAGGGAAASARSWALGRRWAGRAECSAAAGSEERAEPAMGKSASKQFHNEVLKAHNEYRQKHGVPPLKLCKNLNREAQQYSEALASTRILKHSPESSRGQCGENLAWASYDQTGKEVADRWYMKFILCDLHAS

SEQ ID NO: 896090 - protein, 145 aa, Homo sapiens
RPHPGSPRQSRSCFPGVSSPGGPRGGPGRLRPQLSLLIRRGPGGAGGGAAASARSWALGRRWAGRAECSAAAGSEERAEPAMGKSGEPAGSPAAEWFGTPRSRTSPSPSSAASQVLGSAGARGAGGGRAGGAPRRGFRGTRGEGE

SEQ ID NO: 896091 - protein, 164 aa, Homo sapiens
MWCFVYAVKHFGDLQKEGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896092 - protein, 335 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896093 - protein, 348 aa, Homo sapiens
MTSSLSLSCRIRGMKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896094 - protein, 335 aa, Homo sapiens; identical to SEQ ID NO: 896092

SEQ ID NO: 896095 - protein, 335 aa, Homo sapiens; identical to SEQ ID NO: 896092

SEQ ID NO: 896096 - protein, 335 aa, Homo sapiens; identical to SEQ ID NO: 896092

SEQ ID NO: 896097 - protein, 335 aa, Homo sapiens; identical to SEQ ID NO: 896092

SEQ ID NO: 896098 - protein, 326 aa, Homo sapiens
MSGLGKKHLLLMGEFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896099 - protein, 326 aa, Homo sapiens; identical to SEQ ID NO: 896098

SEQ ID NO: 896100 - protein, 313 aa, Homo sapiens [sequence omitted]

SEQ ID NO: 896101 - protein, 326 aa, Homo sapiens
MTAYLATGILWKEMFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896102 - protein, 355 aa, Homo sapiens
AAWVPVPVPSPGGLGSVSSPENFVLFVPPPAPNRLRRLPARVLETQHEATGQGFLYSGVPAALWPRSSEAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896103 - protein, 243 aa, Homo sapiens
MDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896104 - protein, 322 aa, Homo sapiens
AAWVPVPVPSPGGLGSVSSPENFVLFVPPPAPNRLRRLPARVLETQHEATGQGFLYSGVPAALWPRSSEGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896105 - protein, 269 aa, Homo sapiens [sequence omitted]

SEQ ID NO: 896106 - protein, 269 aa, Homo sapiens [sequence omitted]

SEQ ID NO: 896107 - protein, 386 aa, Homo sapiens
AAWVPVPVPSPGGLGSVSSPENFVLFVPPPAPNRLRRLPARVLETQHEATGQGFLYSGVPAALWPRSSEAMLPPNSFQGKVAFITGGGTGLGKGMTTLLSSLGAQCVIASRNAFLQAMDSLYSSIYEIEKYNMKSYKVFISRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896108 - protein, 318 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896109 - protein, 225 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSNSCS

SEQ ID NO: 896110 - protein, 203 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGLLQLNGVNMECDSM

SEQ ID NO: 896111 - protein, 103 aa, Homo sapiens
MRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 896112 - protein, 203 aa, Homo sapiens; identical to SEQ ID NO: 896110

SEQ ID NO: 896113 - protein, 70 aa, Homo sapiens
AAWVPVPVPSPGGLGSVSSPENFVLFVPPPAPNRLRRLPARVLETQHEATGQGFLYSGVPAALWPRSSEV

SEQ ID NO: 896114 - protein, 116 aa, Homo sapiens
QQGGVAPRFLTSPPTAYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 896115 - protein, 130 aa, Homo sapiens
MGLSSAISASTCLALLPRPERCLQAWVDEARGFLPSWKAFPCLEFMKDQQAMRQEKRPWGRGAPREAGLALTSNPVPPPCRMLVDCVPLVEVDDMMIMGKKPDPKCVFTYVQSLYNHLRRHELRLRGKNV

SEQ ID NO: 896116 - protein, 915 aa, Homo sapiens [sequence omitted]

SEQ ID NO: 896117 - protein, 45 aa, Homo sapiens
MGTGVGQFHVADAEALVACACPCLVLKPSPSQPSTATTCLNSNCC

SEQ ID NO: 896118 - protein, 917 aa, Homo sapiens [sequence omitted]

SEQ ID NO: 896119 - protein, 596 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEPEPAEPLAAAVEAANGAEQTRVNKAPEGRSPLSAEELMTIEDEGVLDKMV

SEQ ID NO: 896120 - protein, 628 aa, Homo sapiens [sequence omitted]

SEQ ID NO: 896121 - protein, 596 aa, Homo sapiens; identical to SEQ ID NO: 896119

SEQ ID NO: 896122 - protein, 984 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEPEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSESKATWCRPVPACLSAHLLRLFLELSLRVFNCAVTFSSLPAAITTPPYSLPSHLLMSSPGPHLVPLPLFADGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 896123 - protein, 646 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEPEPAEPLAAAVEAANGAEQTRVNKAPEGRSPLSAEELMTIEDEGVLDKMLDQSTDFEERKLIRAALRELRQRKRDPDTPSRSYSLLGSSCLSKYCQRLLP

SEQ ID NO: 896124 - protein, 839 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEPEPAEPLAAAVEAANGAEQTRVNKAPEGRSPLSAEELMTIEDEGVLDKMLDQSTDFEERKLIRAALRELRQRKRDGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 896125 - protein, 352 aa, Homo sapiens
MAVPSPQLLLERPLLPVSFMFLTSHPPPRLVCPMHLCICAVWVLVALLRMHGASPAQNQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 896126 - protein, 352 aa, Homo sapiens; identical to SEQ ID NO: 896125

SEQ ID NO: 896127 - protein, 596 aa, Homo sapiens; identical to SEQ ID NO: 896119

SEQ ID NO: 896128 - protein, 233 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPVACTSPVAVPHQELYLTRSCTSPV

SEQ ID NO: 896129 - protein, 45 aa, Homo sapiens
AGEDLDSTAQHPRPVSYPQLRSAGEYEERKLIRAAIRRVRAQEIE

SEQ ID NO: 896130 - protein, 946 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKAAEDAGTPVAHPPAFSTRRRSSTGTTRSTSLMEPEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 896131 - protein, 596 aa, Homo sapiens; identical to SEQ ID NO: 896119

SEQ ID NO: 896132 - protein, 352 aa, Homo sapiens; identical to SEQ ID NO: 896125

SEQ ID NO: 896133 - protein, 596 aa, Homo sapiens; identical to SEQ ID NO: 896119

SEQ ID NO: 896134 - protein, 211 aa, Homo sapiens
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPAIKGAVQLL

SEQ ID NO: 896135 - protein, 227 aa, Homo sapiens
MFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 896136 - protein, 227 aa, Homo sapiens; identical to SEQ ID NO: 896135

SEQ ID NO: 896137 - protein, 227 aa, Homo sapiens; identical to SEQ ID NO: 896135

SEQ ID NO: 896138 - protein, 268 aa, Homo sapiens
MFKRMAEFGPDSGGRVKGVTIVKPIVYGNVARYFGKKREEDGHTHQWTVYVKPYRNEAKWLIPVISALWEAQAGGSLEPRSLRPDWQHSKTPSLQKKKDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 896139 - protein, 266 aa, Homo sapiens
MFKRMAEFGPDSGGRVKLECTSAISALRNLHLLDSSDSPASTRFSCLSLLNELELQGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 896140 - protein, 173 aa, Homo sapiens
MFKRMAEFGPDSGGRVKGVTIVKPIVYGNVARYFGKKREEDGHTHQWTVYVKPYRNEVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 896141 - protein, 647 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896142 - protein, 618 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896143 - protein, 631 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTVITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896144 - protein, 596 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896145 - protein, 545 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896146 - protein, 631 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLAVLYLLLCLSTIITLLYHWIILKQIPGHHVTHKYFRRVSSKVFFTLFALLGFFICFFGHRFWKTELFFIGFIIMGFFFYILITRLTPIKYDGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896147 - protein, 361 aa, Homo sapiens
MLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896148 - protein, 647 aa, Homo sapiens; identical to SEQ ID NO: 896141

SEQ ID NO: 896149 - protein, 647 aa, Homo sapiens; identical to SEQ ID NO: 896141

SEQ ID NO: 896150 - protein, 411 aa, Homo sapiens
MRAPRDSVGEAAGPRRARPHLSPALAWAQPGPGSNGVPAAAGRSGAGIRTPGGWCSRGLREFQRGGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896151 - protein, 234 aa, Homo sapiens
VRSNRYAPRVVVLDREGRPFLWYVHGSVCGALEISDLHALCKKKKLSFLIFVSDYYTPLGNLKMHDDGVFWVTYYKDRPIPHSSNKQGLDKGGLNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896152 - protein, 387 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGEYVALNFYKFSFGLADNAFV

SEQ ID NO: 896153 - protein, 219 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERVLSESGSELN

SEQ ID NO: 896154 - protein, 215 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERGESGDP

SEQ ID NO: 896155 - protein, 109 aa, Homo sapiens
GCIIMLDFKILEFKLYFFYCFLDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896156 - protein, 647 aa, Homo sapiens; identical to SEQ ID NO: 896141

SEQ ID NO: 896157 - protein, 570 aa, Homo sapiens
RALGVRCRKRKPLAGARSSAGRAPAAAELAGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896158 - protein, 448 aa, Homo sapiens
MAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896159 - protein, 440 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDAEHTDLWSHWLLFGGFSH

SEQ ID NO: 896160 - protein, 462 aa, Homo sapiens
MRAPRDSVGEAAGPRRARPHLSPALAWAQPGPGSNGVPAAAGRSGAGIRTPGGWCSRGLREFQRGGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896161 - protein, 333 aa, Homo sapiens
MWSSAPILPSLTSFSLSRICNVIPLTASMPQYCQDNEVISLKRHICESSVEILVERSLEYVQSDVGKACGPVTCQWLKPPNELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896162 - protein, 192 aa, Homo sapiens
CHCFQLDGSHLCVFLYSTGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896163 - protein, 150 aa, Homo sapiens
MPKLFHSSTLNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 896164 - protein, 488 aa, Homo sapiens
RALGVRCRKRKPLAGARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGRRYVTDVLCVRVTV

SEQ ID NO: 896165 - protein, 82 aa, Homo sapiens
GKIWNRTCTLDQLSNLCFGRLPIHDNVSSGLQTLLSNSSETGTASGLVFILRPEQSTCTWYLGTSGIQPVQNMAILLSYSER

SEQ ID NO: 896166 - protein, 368 aa, Homo sapiens
MISDPPSNNSWNSVLYLLEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 896167 - protein, 481 aa, Homo sapiens
MAAAPGGSAQPAGPGPRLGFSTADSGVGMSGLNPGPAVPMKDHDAIKLFVGQIPRGLDEQDLKPLFEEFGRIYELTVLKDRLTGLHKGCAFLTYCARDSALKAQSALHEQKTLPGMNRPIQVKPAASEGRGEDRKLFVGMLGKQQGEEDVRRLFQPFGHIEECTVLRSPDGTSKGCAFVKFGSQGEAQAAIRGLHGSRTMAGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAAAYPSAYAPVSTAFPQQPSALPQQQREGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 896168 - protein, 626 aa, Homo sapiens
DALDAVQESAAASRLGPERGGRQAGPLAGSLRRTAPAWRRFPSSVPTGPAAPPSLRPAPEKTHSSGRAGAGAAEPLLPGSSRRKAKLRADAARAGPQPRRVGAAGGVSAAGDKGVPHLKTASWVLSDAPQLSVQGWPEEPPLAPPFPMEKGLTLPQDCRDFVHSLKMRSKYALFLVFVVIVFVFIEKENKIISRVSDKLKQIPQALADANSTDPALILAENASLLSLSELDSAFSQLQSRLRNLSLQLGVEPAMEAAGEEEEEQRKEEEPPRPAVAGPRRHVLLMATTRTGSSFVGEFFNQQGNIFYLFEPLWHIERTVSFEPGGANAAGSALVYRDVLKQLFLCDLYVLEHFITPLPEDHLTQFMFRRGSSRSLCEDPVCTPFVKKVFEKYHCKNRRCGPLNVTLAAEACRRKEHMALKAVRIRQLEFLQPLAEDPRLDLRVIQLVRDPRAVLASRMVAFAGKYKTWKKWLDDEGQDGLREEEVQRLRGNCESIRLSAELGLRQPAWLRGRYMLVRYEDVARGPLQKAREMYRFAGIPLTPQVEDWIQKNTQAAHDGSGIYSTQKNSSEQFEKWRFSMPFKLAQVVQAACGPAMRLFGYKLARDAAALTNRSVSLLEERGTFWVT

SEQ ID NO: 896169 - protein, 107 aa, Homo sapiens
MFPGSVFPWGSAMLWEPLGFGEGQCGVTIGLKRYGYGWSHPCGYDFQLGAGMEKMEALVAGPLFPARPALASPLFQLVCQKPSPARCPPARRQREQLRPLSTGRQPP

SEQ ID NO: 896170 - protein, 76 aa, Homo sapiens
QGASPPRPSPGGAAAPARYPRPAGGRSGGRVPEAGAKGLPLTRAFGGLRRPDDAVQVENGQQNREIWMQRHRENAM

SEQ ID NO: 896171 - protein, 163 aa, Homo sapiens
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 896172 - protein, 163 aa, Homo sapiens; identical to SEQ ID NO: 896171

SEQ ID NO: 896173 - protein, 135 aa, Homo sapiens
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLGE

SEQ ID NO: 896174 - protein, 206 aa, Homo sapiens
MEWKIVLALVEAANEMKRARLQSGCRGNGVNLCSEARSNGVAGLARPPLPRFPAPGVPTHGRPRSRVLTRVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 896175 - protein, 153 aa, Homo sapiens
MAAAVVLAAGLRAARRAVAATGVRGGQVRGAAGVTDGNEVAKAQQATPGGAAPTIFSRILDKSLPADILYEDQQAPVHFLVIPKKPIPRISQAEEEDQQLLGHLLLVAKQTAKAEGLGDGYRLVINDGKLGAQSVYHLHIHVLGGRQLQWPPG

SEQ ID NO: 896176 - protein, 532 aa, Homo sapiens
RPRRSHKMAAGGSGGRASCPPGVGVGPGTGGSPGPSANAAATPAPGNAAAAAAAAAAAAAAPGPTPPAPPGPGTDAQAAGAERAEEAAGPGAAALQREAAYNWQASKPTVQERFAFLFNNEVLCDVHFLVGKGLSSQRIPAHRFVLAVGSAVFDAMFNGGMATTSTEIELPDVEPAAFLALLKFLYSDEVQIGPETVMTTLYTAKKYAVPALEAHCVEFLKKNLRADNAFMLLTQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHTDSNTVLGQNDTGFSCDGSASTFRVMFKEPVEVLPNVNYTACATLKGPDSHYGTKGLRKVTHESPTTGAKTCFTFCYAAGNNNGTSVEDGQIPEVIFYT

SEQ ID NO: 896177 - protein, 302 aa, Homo sapiens
MVSCQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHTDSNTVLGQNDTGFSCDGSASTFRVMFKEPVEVLPNVNYTACATLKGPDSHYGTKGLRKVTHESPTTGAKTCFTFCYAAGNNNGTSVEDGQIPEVIFYT

SEQ ID NO: 896178 - protein, 377 aa, Homo sapiens
MFNGGMATTSTEIELPDVEPAAFLALLKFLYSDEVQIGPETVMTTLYTAKKYAVPALEAHCVEFLKKNLRADNAFMLLTQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHTDSNTVLGQNDTGFSCDGSASTFRVMFKEPVEVLPNVNYTACATLKGPDSHYGTKGLRKVTHESPTTGAKTCFTFCYAAGNNNGTSVEDGQIPEVIFYT

SEQ ID NO: 896179 - protein, 276 aa, Homo sapiens [sequence omitted]

SEQ ID NO: 896180 - protein, 397 aa, Homo sapiens
RPRRSHKMAAGGSGGRASCPPGVGVGPGTGGSPGPSANAAATPAPGNAAAAAAAAAAAAAAPGPTPPAPPGPGTDAQAAGAERAEEAAGPGAAALQREAAYNWQASKPTVQERFAFLFNNEVLCDVHFLVGKGLSSQRIPAHRFVLAVGSAVFDAMFNGGMATTSTEIELPDVEPAAFLALLKFLYSDEVQIGPETVMTTLYTAKKYAVPALEAHCVEFLKKNLRADNAFMLLTQARLFDEPQLASLCLENIDKNTADAITAEGFTDIDLDTLVAVLERDTLGIREVRLFNAVVRWSEAECQRQQLQVPHSRASWWTARWSASSCTSPSTPSHEWSSLTGPAAACVGRSAASTASSRWRVAGATAGPVTASGSQSTSASSWWDLGCMDPSTGPPTTK

SEQ ID NO: 896181 - protein, 532 aa, Homo sapiens; identical to SEQ ID NO: 896176

SEQ ID NO: 896182 - protein, 532 aa, Homo sapiens; identical to SEQ ID NO: 896176

SEQ ID NO: 896183 - protein, 276 aa, Homo sapiens
RPRRSHKMAAGGSGGRASCPPGVGVGPGTGGSPGPSANAAATPAPGNAAAAAAAAAAAAAAPGPTPPAPPGPGTDAQAAGAERAEEAAGPGAAALQREAAYNWQASKPTVQERFAFLFNNEVLCDVHFLVGKGLSSQRIPAHRFVLAVGSAVFDAMFNGGMATTSTEIELPDVEPAAFLALLKFLYSDEVQIGPETVMTTLYTAKKYAVPALEAHCVEFLKKNLRADNAFMLLTQAGVQWRDLSSLQPSPPAFKRFSCLSLHSSWDYRPPPPRLAK

SEQ ID NO: 896184 - protein, 122 aa, Homo sapiens [sequence omitted]

SEQ ID NO: 896185 - protein, 204 aa, Homo sapiens
MTIEEFAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHTDSNTVLGQNDTGFSCDGSASTFRVMFKEPVEVLPNVNYTACATLKGPDSHYGTKGLRKVTHESPTTGAKTCFTFCYAAGNNNGTSVEDGQIPEVIFYT

SEQ ID NO: 896186 - protein, 532 aa, Homo sapiens; identical to SEQ ID NO: 896176

SEQ ID NO: 896187 - protein, 157 aa, Homo sapiens [sequence omitted]

SEQ ID NO: 896188 - protein, 196 aa, Homo sapiens
AHAAATKWRRVGAAGVRRARRGSGSARARGAVPGPAPTPPPPRPPATRPPPPPPPPPPPPPLGRRRPPRRAPGQTRRPRARSGRRRRRARGRRRCSARPRTTGRPASPPCRSASPSSSTTRCCATCTSWWARGSARSASPRTGSCWPWAAPSLMPCSTGEWPQHPRRLSCPTWNPLPSSHCSSFSTRTRCRLARRR

SEQ ID NO: 896189 - protein, 122 aa, Homo sapiens [sequence omitted]

SEQ ID NO: 896190 - protein, 423 aa, Homo sapiens
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRQPSPVPSFRVAWTEKNDGQRAPLANNLLPTSQLQSGKTDLSSVEPIVTMS

SEQ ID NO: 896191 - protein, 166 aa, Homo sapiens
MAGQAGGADLALPEAGCGPQASLEEGERGGQEPLLPLREAGQHPPSARSASQGARPLSTGKLEGFQSIDEAIAWLRKELTEMRLQDQQLARQLMRLRGDINKLKIEHTCRLHRRMLNDATYELEERDELADLFCDSPLASSFSLSTPLKLIGVTKMNINSRRFSLC

SEQ ID NO: 896192 - protein, 166 aa, Homo sapiens; identical to SEQ ID NO: 896191

SEQ ID NO: 896193 - protein, 166 aa, Homo sapiens; identical to SEQ ID NO: 896191

SEQ ID NO: 896194 - protein, 166 aa, Homo sapiens; identical to SEQ ID NO: 896191

SEQ ID NO: 896195 - protein, 166 aa, Homo sapiens; identical to SEQ ID NO: 896191

SEQ ID NO: 896196 - protein, 166 aa, Homo sapiens; identical to SEQ ID NO: 896191

SEQ ID NO: 896197 - protein, 166 aa, Homo sapiens; identical to SEQ ID NO: 896191

SEQ ID NO: 896198 - protein, 342 aa, Homo sapiens
ARSNIRMVTAFRSLPAGSSGAARAMSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 896199 - protein, 342 aa, Homo sapiens; identical to SEQ ID NO: 896198

SEQ ID NO: 896200 - protein, 342 aa, Homo sapiens; identical to SEQ ID NO: 896198

SEQ ID NO: 896201 - protein, 318 aa, Homo sapiens
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 896202 - protein, 230 aa, Homo sapiens
MHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 896203 - protein, 363 aa, Homo sapiens
ARSNIRMVTAFRSLPAGSSGAARAMSAHNRGTELARWLENPTTQKTKPKTNNPQADLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 896204 - protein, 112 aa, Homo sapiens [sequence omitted]

SEQ ID NO: 896205 - protein, 300 aa, Homo sapiens
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVLAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 896206 - protein, 275 aa, Homo sapiens
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 896207 - protein, 315 aa, Homo sapiens
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQVSNHLCLWNKLTSVF

SEQ ID NO: 896208 - protein, 219 aa, Homo sapiens
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGKCFMFK

SEQ ID NO: 896209 - protein, 331 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEEQIKPVNPVFCMPEEVLQRVNVQPELVS

SEQ ID NO: 896210 - protein, 331 aa, Homo sapiens; identical to SEQ ID NO: 896209

SEQ ID NO: 896211 - protein, 291 aa, Homo sapiens [sequence omitted]

SEQ ID NO: 896212 - protein, 291 aa, Homo sapiens [sequence omitted]

SEQ ID NO: 896213 - protein, 291 aa, Homo sapiens [sequence omitted]

SEQ ID NO: 896214 - protein, 331 aa, Homo sapiens; identical to SEQ ID NO: 896209

SEQ ID NO: 896215 - protein, 291 aa, Homo sapiens [sequence omitted]

SEQ ID NO: 896216 - protein, 265 aa, Homo sapiens
MGTPQKDVIIKSDAPDTLLLEKHADYIASYGSKKDDYILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEEQIKPVNPVFCMPEEVLQRVNVQPELVS

SEQ ID NO: 896217 - protein, 316 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEVLQRVNVQPELVS

SEQ ID NO: 896218 - protein, 281 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKVDPFHTLFGIAGLSLLGEEQIKPVNPVFCMPEEVLQRVNVQPELVS

SEQ ID NO: 896219 - protein, 199 aa, Homo sapiens
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQVIYEYR

SEQ ID NO: 896220 - protein, 782 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 896221 - protein, 115 aa, Homo sapiens
RDKCAHFRNLLFRLWHDECCSLRSFEALKPLLAMPSLDQRASSLPFLISLCQPCFLCNHEHLPLSGAHLLSSFPGSLSVLLDDLQDLSEAISKEEAVCQGDNLDRCSSSNPQMSS

SEQ ID NO: 896222 - protein, 782 aa, Homo sapiens; identical to SEQ ID NO: 896220

SEQ ID NO: 896223 - protein, 782 aa, Homo sapiens; identical to SEQ ID NO: 896220

SEQ ID NO: 896224 - protein, 782 aa, Homo sapiens; identical to SEQ ID NO: 896220

SEQ ID NO: 896225 - protein, 808 aa, Homo sapiens
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 896226 - protein, 808 aa, Homo sapiens; identical to SEQ ID NO: 896225

SEQ ID NO: 896227 - protein, 506 aa, Homo sapiens
MQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 896228 - protein, 768 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 896229 - protein, 659 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAGHLAAGRSPLPLQAAATVDSSSFPTG

SEQ ID NO: 896230 - protein, 736 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAMSS

SEQ ID NO: 896231 - protein, 536 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEGRQSGSS

SEQ ID NO: 896232 - protein, 215 aa, Homo sapiens
EKWDLTILPRLDLNSLKSSHLRLLSELELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 896233 - protein, 107 aa, Homo sapiens
RLEEEVRLLRETSLQQKMRLEAQAMELEALARAEKAGRAEAEGLRAALAGAEVVRKNLEEGSQRELEEVQRLHQEQVNAGVERIQIHNGELGSSFQAKNRYCRKDPP

SEQ ID NO: 896234 - protein, 973 aa, Homo sapiens
MASILDEYENSLSRSAVLQPGCPSVGIPHSGYVNAQLEKEVPIFTKQRIDFTPSERITSLVVSSNQLCMSLGKDTLLRIDLGKANEPNHVELGRKDDAKVHKMFLDHTGSHLLIALSSTEVLYVNRNGQKVRPLARWKGQLVESVGWNKALGTESSTGPILVGTAQGHIFEAELSASEGGLFGPAPDLYFRPLYVLNEEGGPAPVCSLEAERGPDGRSFVIATTRQRLFQFIGRAAEGAEAQGFSGLFAAYTDHPPPFREFPSNLGYSELAFYTPKLRSAPRAFAWMMGDGVLYGALDCGRPDSLLSEERVWEYPEGVGPGASPPLAIVLTQFHFLLLLADRVEAVCTLTGQVVLRDHFLEKFGPLKHMVKDSSTGQLWAYTERAVFRYHVQREARDVWRTYLDMNRFDLAKEYCRERPDCLDTVLAREADFCFRQRRYLESARCYALTQSYFEEIALKFLEARQEEALAEFLQRKLASLKPAERTQATLLTTWLTELYLSRLGALQGDPEALTLYRETKECFRTFLSSPRHKEWLFASRASIHELLASHGDTEHMVYFAVIMQDYERVVAYHCQHEAYEEALAVLARHRDPQLFYKFSPILIRHIPRQLVDAWIEMGSRLDARQLIPALVNYSQGGEVQQVSQAIRYMEFCVNVLGETEQAIHNYLLSLYARGRPDSLLAYLEQAGASPHRVHYDLKYALRLCAEHGHHRACVHVYKVLELYEEAVDLALQVDVDLAKQCADLPEEDEELRKKLWLKIARHVVQEEEDVQTAMACLASCPLLKIEDVLPFFPDFVTIDHFKEAICSSLKAYNHHIQELQREMEEATASAQRIRRDLQELRGRYGTVEPQDKCATCDFPLLNRPFYLFLCGHMFHADCLLQAVRPGLPAYKQARLEELQRKLGAAPPPAKGSARAKEAEGGAATAGPSREQLKADLDELVAAECVYCGELMIRSIDRPFIDPQRYEEEQLSWL

SEQ ID NO: 896235 - protein, 962 aa, Homo sapiens
MASILDEYENSLSRSAVLQPGCPSVGIPHSGYVNAQLEKEVPIFTKQRIDFTPSERITSLVVSSNQLCMSLGKDTLLRIDLGKANEPNHVELGRKDDAKVHKMFLDHTGSHLLIALSSTEVLYVNRNGQKVRPLARWKGQLVESVGWNKALGTESSTGPILVGTAQGHIFEAELSASEGGLFGPAPDLYFRPLYVLNEEGGPAPVCSLEAERGPDGRSFVIATTRQRLFQFIGRAAEGAEAQGFSGLFAAYTDHPPPFREFPSNLGYSELAFYTPKLRSAPRAFAWMMGDGVLYGALDCGRPDSLLSEERVWEYPEGVGPGASPPLAIVLTQFHFLLLLADRVEAVCTLTGQVVLRDHFLEKFGPLKHMVKDSSTGQLWAYTERAVFRYHVQREARDVWRTYLDMNRFDLAKEYCRERPDCLDTVLAREADFCFRQRRYLESARCYALTQSYFEEIALKFLEARQMASLKPAERTQATLLTTWLTELYLSRLGALQGDPEALTLYRETKECFRTFLSSPRHKEWLFASRASIHELLASHGDTEHMVYFAVIMQDYERVVAYHCQHEAYEEALAVLARHRDPQLFYKFSPILIRHIPRQLVDAWIEMGSRLDARQLIPALVNYSQGGEVQQVSQAIRYMEFCVNVLGETEQAIHNYLLSLYARGRPDSLLAYLEQAGASPHRVHYDLKYALRLCAEHGHHRACVHVYKVLELYEEAVDLALQVDVDLAKQCADLPEEDEELRKKLWLKIARHVVQEEEDVQTAMACLASCPLLKIEDVLPFFPDFVTIDHFKEAICSSLKAYNHHIQELQREMEEATASAQRIRRDLQELRGRYGTVEPQDKCATCDFPLLNRPFYLFLCGHMFHADCLLQAVRPGLPAYKQARLEELQRKLGAAPPPAKGSARAKEAEGGAATAGPSREQLKADLDELVAAECVYCGELMIRSIDRPFIDPQRYEEEQLSWL

SEQ ID NO: 896236 - protein, 254 aa, Homo sapiens
MTQKFTRCSLTILVDVDLAKQCADLPEEDEELRKKLWLKIARHVVQEEEDVQTAMACLASCPLLKIEDVLPFFPDFVTIDHFKEAICSSLKAYNHHIQELQREMEEATASAQRIRRDLQELRGRYGTVEPQDKCATCDFPLLNRPFYLFLCGHMFHADCLLQAVRPGLPAYKQARLEELQRKLGAAPPPAKGSARAKEAEGGAATAGPSREQLKADLDELVAAECVYCGELMIRSIDRPFIDPQRYEEEQLSWL

SEQ ID NO: 896237 - protein, 973 aa, Homo sapiens; identical to SEQ ID NO: 896234

SEQ ID NO: 896238 - protein, 525 aa, Homo sapiens
MASILDEYENSLSRSAVLQPGCPSVGIPHSGYVNAQLEKEVPIFTKQRIDFTPSERITSLVVSSNQLCMSLGKDTLLRIDLGKANEPNHVELGRKDDAKVHKMFLDHTGSHLLIALSSTEVLYVNRNGQKVRPLARWKGQLVESVGWNKALGTESSTGPILVGTAQGHIFEAELSASEGGLFGPAPDLYFRPLYVLNEEGGPAPVCSLEAERGPDGRSFVIATTRQRLFQFIGRAAEGAEAQGFSGLFAAYTDHPPPFREFPSNLGYSELAFYTPKLRSAPRAFAWMMGDGVLYGALDCGRPDSLLSEERVWEYPEGVGPGASPPLAIVLTQFHFLLLLADRVEAVCTLTGQVVLRDHFLEKFGPLKHMVKDSSTGQLWAYTERAVFRYHVQREARDVWRTYLDMNRFDLAKEYCRERPDCLDTVLAREADFCFRQRRYLESARCYALTQSYFEEIALKFLEARQEEALAEFLQRKLASLKPAERTQATLLTTWLTELYLSRLGALQGDPEALTLSEEAFSSSCL

SEQ ID NO: 896239 - protein, 178 aa, Homo sapiens
MSEVRLPPLRALDDFVLGSARLAAPDPCDPQRWCHRVINNLLYYQTNYLLCFGIGLALAGYVRPLHTLLSALVVAVALGVLVWAAETRAAVRRCRRSHPAACLAAVLAVGLLVLWVAGGACTFLFSIAGPVLLILVHASLRLRNLKNKIENKIESIGLKRTPMGLLLEALGQEQEAGS

SEQ ID NO: 896240 - protein, 178 aa, Homo sapiens; identical to SEQ ID NO: 896239

SEQ ID NO: 896241 - protein, 178 aa, Homo sapiens; identical to SEQ ID NO: 896239

SEQ ID NO: 896242 - protein, 78 aa, Homo sapiens
TVVVVRPPPGWSSHINRQDVGGAAATATRPGRLCSGVGASGGSGSMRPAAMVPPRHQQPPLLPNQLPSLLRHRPRSRR

SEQ ID NO: 896243 - protein, 178 aa, Homo sapiens; identical to SEQ ID NO: 896239

SEQ ID NO: 896244 - protein, 160 aa, Homo sapiens
MSEVRLPPLRALDDFVLGSARLAAPDPCDPQRWCHRVINNLLYYQTNYLLCFGIGLALAGYVRPLHTLLSALVVAVALGVLVWAAETRAAVRRCRRSHPAACLAAVLAVGLLVLWVAGGACTFLFSIAGPVLRESPLPRDSQESSQSMLKAPGQPCRSPG

SEQ ID NO: 896245 - protein, 4365 aa, Homo sapiens
MYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYNPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAE

SEQ ID NO: 896246 - protein, 4365 aa, Homo sapiens; identical to SEQ ID NO: 896245

SEQ ID NO: 896247 - protein, 4365 aa, Homo sapiens; identical to SEQ ID NO: 896245

SEQ ID NO: 896248 - protein, 4365 aa, Homo sapiens; identical to SEQ ID NO: 896245

SEQ ID NO: 896249 - protein, 414 aa, Homo sapiens
RIQRPLNSSTGVQKVIAAVVAMGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETGPLKGRRVEGIQYEDISKLA

SEQ ID NO: 896250 - protein, 395 aa, Homo sapiens
RIQRPLNSSTGVQKVIAAVVAMGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETV

SEQ ID NO: 896251 - protein, 395 aa, Homo sapiens; identical to SEQ ID NO: 896250

SEQ ID NO: 896252 - protein, 371 aa, Homo sapiens
RIQRPLNSSTGVQKVIAAVVAMGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGVFAFWKLIRI

SEQ ID NO: 896253 - protein, 160 aa, Homo sapiens
RIQRPLNSSTGVQKVIAAVVAMGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGKNEILKLLFLSHF

SEQ ID NO: 896254 - protein, 233 aa, Homo sapiens
RIQRPLNSSTGVQKVIAAVVAMGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKGSFIFYFFFF

SEQ ID NO: 896255 - protein, 155 aa, Homo sapiens
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPGSLGLF

SEQ ID NO: 896256 - protein, 213 aa, Homo sapiens
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPENRAVSSGPSLLTVFLGVVCIAALMLPTLGDVESLVPLYLHLSVNQKLVAAYILGLITMAILRT

SEQ ID NO: 896257 - protein, 159 aa, Homo sapiens
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPGLITMAILRT

SEQ ID NO: 896258 - protein, 213 aa, Homo sapiens; identical to SEQ ID NO: 896256

SEQ ID NO: 896259 - protein, 213 aa, Homo sapiens; identical to SEQ ID NO: 896256

SEQ ID NO: 896260 - protein, 213 aa, Homo sapiens; identical to SEQ ID NO: 896256

SEQ ID NO: 896261 - protein, 213 aa, Homo sapiens; identical to SEQ ID NO: 896256

SEQ ID NO: 896262 - protein, 467 aa, Homo sapiens
MRTAPSLRRCVCLLLAAILDLARGYLTVNIEPLPPVVAGDAVTLKCNFKTDGRMREIVWYRVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 896263 - protein, 419 aa, Homo sapiens
APSPCSHFNCGSQVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 896264 - protein, 412 aa, Homo sapiens
MARGPAGNRLSPKLSSHHGGKLSASAEGPLGVSRPPVYGVPEGARDLLDHMGALYCSCPCGATLSSSAHPGEKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 896265 - protein, 120 aa, Homo sapiens
MTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 896266 - protein, 343 aa, Homo sapiens [sequence omitted]

SEQ ID NO: 896267 - protein, 454 aa, Homo sapiens
MDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 896268 - protein, 517 aa, Homo sapiens
MGLGQPQAWLLGLPTAVVYGSLALFTTILHNVFLLYYVDTFVSVYKINKMAFWVGETVFLLWNSLNDPLFGWLSDRQFLSSQPRSGAGLSSRAVVLARVQALGWHGPLLALSFLAFWVPWAPAGLQFLLCLCLYDGFLTLVDLHHHALLADLALSAHDRTHLNFYWSLFSAAGSLSVFASYAFWNKEDFSSFRAFCVTLAVSSGLGFLGATQLLRRRVEAARKDPGCSGLVVDSGLCGEELLVGSEEADSITLGRYLRQLARHRNFLWFVSMDLVQVFHCHFNSNFFPLFLEHLLSDHISLSTGSILLGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 896269 - protein, 517 aa, Homo sapiens; identical to SEQ ID NO: 896268

SEQ ID NO: 896270 - protein, 517 aa, Homo sapiens; identical to SEQ ID NO: 896268

SEQ ID NO: 896271 - protein, 236 aa, Homo sapiens
MQSAVKLMALTGTAAVPLKGGSPSSSPGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 896272 - protein, 120 aa, Homo sapiens
MGLGQPQAWLLGLPTAVVYGSLALFTTILHNVFLLYYVDTFVSVYKINKMAFWVGEAGVQWRNLSSLQPPPSWFKWFSCLNLMSRWDYKHPPPRPANFCIFSRDGVSPCWPGWSQTPDLR

SEQ ID NO: 896273 - protein, 517 aa, Homo sapiens; identical to SEQ ID NO: 896268

SEQ ID NO: 896274 - protein, 723 aa, Homo sapiens
MGLGQPQAWLLGLPTAVVYGSLALFTTILHNVFLLYYVDTFVSVYKINKMAFWVGETVFLLWNSLNDPLFGWLSDRQFLSSQPRSGAGLSSRAVVLARVQALGWHGPLLALSFLAFWVPWAPAGLQFLLCLCLYDGFLTLVDLHHHALLADLALSAHDRTHLNFYWSLFSAAGSLSVFASYAFWNKEDFSSFRAFCVTLAVSSGLGFLGATQLLRRRVEAARKDPGCSGLVVDSGLCGEELLVGSEEADSITLGRYLRQLARHRNFLWFVSMDLVQVFHCHFNSNFFPLFLEHLLSDHISLSTGSILLGECGPWVLHASWKERDLYFYVEMGFHRISQDGLHSRPSDPPASASQSTGITGVSHCAQPGTIFLRHQVLPGAVGMGGRVWWVLRGAEAVLVWVLLEMVHPEGVQWLVNTEEYHLMGLGVSLDSVLIWWAASGGLVHLFGPLFLIRKVGMIIVLTLRGCEDEQDSEALSTEPSASLVYRNAVGCEADGAHWHCSSALDKVAAPSSSPGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 896275 - protein, 304 aa, Homo sapiens
MGLGQPQAWLLGLPTAVVYGSLALFTTILHNVFLLYYVDTFVSVYKINKMAFWVGETVFLLWNSLNDPLFGWLSDRQFLSSQPRSGAGLSSRAVVLARVQALGWHGPLLALSFLAFWVPWAPAGLQFLLCLCLYDGFLTLVDLHHHALLADLALSAHDRTHLNFYWSLFSAAGSLSVFASYAFWNKEDFSSFRAFCVTLAVSSGLGFLGATQLLRRRVEAARKDPGCSGLVVDSGLCGEELLVGSEEADSITLGRYLRQLARHRNFLWFVSMDLVQVQWLTPVIPALRDAKVERPLEPRSSRLQ

SEQ ID NO: 896276 - protein, 50 aa, Homo sapiens
MGLGQPQAWLLGLPTAVVYGSLALFTTILHNVFLLYYVDTFVSVYKINKM

SEQ ID NO: 896277 - protein, 1025 aa, Homo sapiens
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLHEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 896278 - protein, 1025 aa, Homo sapiens; identical to SEQ ID NO: 896277

SEQ ID NO: 896279 - protein, 1025 aa, Homo sapiens; identical to SEQ ID NO: 896277

SEQ ID NO: 896280 - protein, 1025 aa, Homo sapiens; identical to SEQ ID NO: 896277

SEQ ID NO: 896281 - protein, 1025 aa, Homo sapiens; identical to SEQ ID NO: 896277

SEQ ID NO: 896282 - protein, 1025 aa, Homo sapiens; identical to SEQ ID NO: 896277

SEQ ID NO: 896283 - protein, 307 aa, Homo sapiens
MGYSKKGGSWCQLNLCVAQNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 896284 - protein, 226 aa, Homo sapiens
MGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 896285 - protein, 416 aa, Homo sapiens
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMAIHHQWL

SEQ ID NO: 896286 - protein, 107 aa, Homo sapiens
RGPNQETPKQSQALQATAHKSNKKNQKPSKAASTKLRNLLLVHPGKHNIFNLICNPLYWAHCLKSQTQQPRQPQSLPRRNFAPPGALLLLCCSSTWLKAESLPNGSL

SEQ ID NO: 896287 - protein, 81 aa, Homo sapiens
MGYGSRALQLLQMYYEGRFPCLEEKVLETPQEIHTVSSEVSIFRQTSCVLVLGRIILWVFRGINKNQSRALDPSLIFFCCF

SEQ ID NO: 896288 - protein, 841 aa, Homo sapiens
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLHEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEQEELQSVPASMAARG

SEQ ID NO: 896289 - protein, 685 aa, Homo sapiens [sequence omitted]

SEQ ID NO: 896290 - protein, 685 aa, Homo sapiens [sequence omitted]

SEQ ID NO: 896291 - protein, 685 aa, Homo sapiens [sequence omitted]

SEQ ID NO: 896292 - protein, 685 aa, Homo sapiens [sequence omitted]

SEQ ID NO: 896293 - protein, 183 aa, Homo sapiens
PAQGRFLLLSVPKLLSSECMSGTDNNRSQHREGSSQDRQAQGDSTEMHGENETTQPHTRNSDSRGGRQLRNPNNLVETGTLPILRLAHFFLLNESDDDDRIRGLTKEQIDNLSTRHYEHNSIDSELGKICSVCISDYVTGNKLRQLPCMHEFHIHCIDRWLSENCTCPICRQPVLGSNIANNG

SEQ ID NO: 896294 - protein, 113 aa, Homo sapiens
MNQSRSRSDGGSEETLPQDHNHHENERRWQQERLHREEAYYQFINELNDEDYRLMRDHNLLGTPGKRWVKEETPFFHHLDGRISRKGELVFFFLASLYENIVYCFCEFKNFLV

SEQ ID NO: 896295 - protein, 142 aa, Homo sapiens
MNQSRSRSDGGSEETLPQDHNHHENERRWQQERLHREEAYYQFINELNDEDYRLMRDHNLLGTPGEITSEELQQRLDGVKEQLASQPDLRDGTNYRDSEVPRESSHEDSLLEWLNTFRRTGNATRSGQNGNQTWRAALPDTS

SEQ ID NO: 896296 - protein, 679 aa, Homo sapiens
MNQSRSRSDGGSEETLPQDHNHHENERRWQQERLHREEAYYQFINELNDEDYRLMRDHNLLGTPELQQRLDGVKEQLASQPDLRDGTNYRDSEVPRESSHEDSLLEWLNTFRRTGNATRSGQNGNQTWRAVSRTNPNNGEFRFSLEIHVNHENRGFEIHGEDYTDIPLSDSNRDHTANRQQRSTSPVARRTRSQTSVNFNGSSSNIPRTRLASRGQNPAEGSFSTLGRLRNGIGGAAGIPRANASRTNFSSHTNQSGGSELRQREGQRFGAAHVWENGARSNVTVRNTNQRLEPIRLRSTSNSRSRSPIQRQSGTVYHNSQRESRPVQQTTRRSVRRRGRTRVFLEQDRERERRGTAYTPFSNSRLVSRITVEEGEESSRSSTAVRRHPTITLDLQVRRIRPGENRDRDSIANRTRSRVGLAENTVTIESNSGGFRRTISRLERSGIRTYVSTITVPLRRISENELVEPSSVALRSILRQIMTGFGELSSLMEADSESELQRNGQHLPDMHSELSNLGTDNNRSQHREGSSQDRQAQGDSTEMHGENETTQPHTRNSDSRGGRQLRNPNNLVETGTLPILRLAHFFLLNESDDDDRIRGLTKEQIDNLSTRHYEHNSIDSELGKICSVCISDYVTGNKLRQLPCMHEFHIHCIDRWLSENCTCPICRQPVLGSNIANNG

SEQ ID NO: 896297 - protein, 198 aa, Homo sapiens [sequence omitted]

SEQ ID NO: 896298 - protein, 188 aa, Homo sapiens
ALLKRSEGGCVFPEDVAALAWAVSRLHFSRLSFPPWAFRGAFAAVPTTAAMISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 896299 - protein, 90 aa, Homo sapiens
ALLKRSEGGCVFPEDVAALAWAVSRLHFSRLSFPPWAFRGAFAAVPTTAAMISLTDTQKIGMGLTGFGVFFLFFGMILFFDKALLAIGNE

SEQ ID NO: 896300 - protein, 188 aa, Homo sapiens; identical to SEQ ID NO: 896298

SEQ ID NO: 896301 - protein, 92 aa, Homo sapiens
ALLKRSEGGCVFPEDVAALAWAVSRLHFSRLSFPPWAFRGAFAAVPTTAAMISLTDTQKIGMGLTGFGVFFLFFGMILFFDKALLAIGNKLL

SEQ ID NO: 896302 - protein, 90 aa, Homo sapiens; identical to SEQ ID NO: 896299

SEQ ID NO: 896303 - protein, 92 aa, Homo sapiens
ALLKRSEGGCVFPEDVAALAWAVSRLHFSRLSFPPWAFRGAFAAVPTTAAMISLTDTQKIGMGLTGFGVFFLFFGMILFFDKALLAIGNVSF

SEQ ID NO: 896304 - protein, 152 aa, Homo sapiens
MDVQVRWSTIQVLAMISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 896305 - protein, 101 aa, Homo sapiens
ALLKRSEGGCVFPEDVAALAWAVSRLHFSRLSFPPWAFRGAFAAVPTTAAMISLTDTQKIGMGLTGFGVFFLFFGMILFFDKALLAIGNKRNETSGTKLQL

SEQ ID NO: 896306 - protein, 170 aa, Homo sapiens
ALLKRSEGGCVFPEDVAALAWAVSRLHFSRLSFPPWAFRGAFAAVPTTAAMISLTDTQKIGMGLTGFGVFFLFFGMILFFDKALLAIGNVLFVAGLAFVIGLERTFRFFFQKHWPLIGMIFEIYGFFLLFRGFFPVVVGFIRRVPVLGSLLNLPGIRSFVDKVGESNNMV

SEQ ID NO: 896307 - protein, 78 aa, Homo sapiens
ALLKRSEGGCVFPEDVAALAWAVSRLHFSRLSFPPWAFRGAFAAVPTTAAMISLTDTQRASFLSLLALLEECQSLDPS

SEQ ID NO: 896308 - protein, 90 aa, Homo sapiens; identical to SEQ ID NO: 896299

SEQ ID NO: 896309 - protein, 188 aa, Homo sapiens; identical to SEQ ID NO: 896298

SEQ ID NO: 896310 - protein, 188 aa, Homo sapiens; identical to SEQ ID NO: 896298

SEQ ID NO: 896311 - protein, 188 aa, Homo sapiens; identical to SEQ ID NO: 896298

SEQ ID NO: 896312 - protein, 673 aa, Homo sapiens
MAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 896313 - protein, 673 aa, Homo sapiens; identical to SEQ ID NO: 896312

SEQ ID NO: 896314 - protein, 673 aa, Homo sapiens; identical to SEQ ID NO: 896312

SEQ ID NO: 896315 - protein, 484 aa, Homo sapiens
MTVALQKGASGGGPCLKQNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 896316 - protein, 235 aa, Homo sapiens
MAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKTLKLTQDLQRKPFAKSALSKWTVIPFTA

SEQ ID NO: 896317 - protein, 37 aa, Homo sapiens
MIEDIYGRTHMYKLFSSIFNNKISQYFLMLCANNYAS

SEQ ID NO: 896318 - protein, 816 aa, Homo sapiens
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 896319 - protein, 816 aa, Homo sapiens; identical to SEQ ID NO: 896318

SEQ ID NO: 896320 - protein, 816 aa, Homo sapiens; identical to SEQ ID NO: 896318

SEQ ID NO: 896321 - protein, 816 aa, Homo sapiens; identical to SEQ ID NO: 896318

SEQ ID NO: 896322 - protein, 540 aa, Homo sapiens
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGSITTGV

SEQ ID NO: 896323 - protein, 210 aa, Homo sapiens
FRASAVALCGPLRRCCPWAPPCSQPTASESAHSSAPGARGRGSSPGPSCGPRGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 896324 - protein, 126 aa, Homo sapiens
MELIFPLLVAFCRLSSLLLVGHTSRSWMCWMKIADLCCVVGLLPPLLILIMTTSGYGISNIDTTIEGTSDDLTVVDAASLRRQIIKLNRRLQLLEEENKERAKREMVMYSITVAFWLLNSWLWFRR

SEQ ID NO: 896325 - protein, 127 aa, Homo sapiens
NIILFDIYLSCFCFYFITSLFPDSVLCLLPQKPALDLCCVVGLLPPLLILIMTTSGYGISNIDTTIEGTSDDLTVVDAASLRRQIIKLNRRLQLLEEENKERAKREMVMYSITVAFWLLNSWLWFRR

SEQ ID NO: 896326 - protein, 218 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 896327 - protein, 218 aa, Homo sapiens; identical to SEQ ID NO: 896326

SEQ ID NO: 896328 - protein, 147 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSL

SEQ ID NO: 896329 - protein, 147 aa, Homo sapiens; identical to SEQ ID NO: 896328

SEQ ID NO: 896330 - protein, 156 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLAQIRFCPKK

SEQ ID NO: 896331 - protein, 283 aa, Homo sapiens
FRASAVALCGPLRRCCPWAPPCSQPTASESAHSSAPGARGRGSSPGPSCGPRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 896332 - protein, 218 aa, Homo sapiens; identical to SEQ ID NO: 896326

SEQ ID NO: 896333 - protein, 283 aa, Homo sapiens; identical to SEQ ID NO: 896331

SEQ ID NO: 896334 - protein, 212 aa, Homo sapiens
FRASAVALCGPLRRCCPWAPPCSQPTASESAHSSAPGARGRGSSPGPSCGPRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSL

SEQ ID NO: 896335 - protein, 156 aa, Homo sapiens; identical to SEQ ID NO: 896330

SEQ ID NO: 896336 - protein, 221 aa, Homo sapiens
FRASAVALCGPLRRCCPWAPPCSQPTASESAHSSAPGARGRGSSPGPSCGPRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLAQIRFCPKK

SEQ ID NO: 896337 - protein, 126 aa, Homo sapiens; identical to SEQ ID NO: 896324

SEQ ID NO: 896338 - protein, 221 aa, Homo sapiens; identical to SEQ ID NO: 896336

SEQ ID NO: 896339 - protein, 200 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 896340 - protein, 182 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLDLCCVVGLLPPLLILIMTTSGMAFQILIQPFEERR

SEQ ID NO: 896341 - protein, 95 aa, Homo sapiens
RDSIFTYFHFLNYPHTTHHLSDEPYGISNIDTTIEGTSDDLTVVDAASLRRQIIKLNRRLQLLEEENKERAKREMVMYSITVAFWLLNSWLWFRR

SEQ ID NO: 896342 - protein, 889 aa, Homo sapiens
KSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSERQPMYSREHGAAASERLQLGTPPPLLAARLVPPRNLMGSSIGYHTSVSSPTPLVPDTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 896343 - protein, 834 aa, Homo sapiens
KSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSEHTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 896344 - protein, 693 aa, Homo sapiens
MIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSEHTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 896345 - protein, 535 aa, Homo sapiens [sequence omitted]

SEQ ID NO: 896346 - protein, 735 aa, Homo sapiens
KSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSEHTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 896347 - protein, 330 aa, Homo sapiens [sequence omitted]

SEQ ID NO: 896348 - protein, 348 aa, Homo sapiens
SAVVCSSSSGYLRALLKEMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 896349 - protein, 834 aa, Homo sapiens; identical to SEQ ID NO: 896343

SEQ ID NO: 896350 - protein, 1152 aa, Homo sapiens
KSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSEHTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSMEFCSCCPGWSAMVRSRLTATSASLVQVILLPQPPKQLRLQERKMMAMNSKQPFGMHPVLQEPKFSSLHSGSEAMRRVCLPAPQLQGNIFGSFDESLLARAEALAAVDIVSHGKNHPFKPDATYHTMSSVPCTSTSSTVPISHPAALTSHPHHAVHQGLEGDLLEHISPTLSVSGLGAPEHSVMPAQIHPHHLGAMGHLHQAMGMSHPHTVAPHSAMPACLSDVESDPRELEAFAERFKQRRIKLGVTQADVGAALANLKIPGVGSLSQSTICRFESLTLSHNNMIALKPVLQAWLEEAEAAYREKNSKPELFNGSERKRKRTSIAAPEKRSLEAYFAIQPRPSSEKIAAIAEKLDLKKNVVRVWFCNQRQKQKRMKYSAVH

SEQ ID NO: 896351 - protein, 113 aa, Homo sapiens
MALSEPILPSFSTFASPCRERGLQERWPRAEPESGGTDDDLNSVLDFILSMGLDGLGAEAAPEPALRHIIEVDPDTKEMLKLLDFGSLSNASRFTQLYEDGMKFQEGLVGGPV

SEQ ID NO: 896352 - protein, 383 aa, Homo sapiens
ARPRPDQPGLGQPLTGVPVRVLPPRVPAMALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 896353 - protein, 383 aa, Homo sapiens; identical to SEQ ID NO: 896352

SEQ ID NO: 896354 - protein, 184 aa, Homo sapiens
KGLGLTPPSRVGLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 896355 - protein, 383 aa, Homo sapiens; identical to SEQ ID NO: 896352

SEQ ID NO: 896356 - protein, 293 aa, Homo sapiens
ARPRPDQPGLGQPLTGVPVRVLPPRVPAMALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAALGPANAPPLTPAATRAAARPTPRVRI

SEQ ID NO: 896357 - protein, 383 aa, Homo sapiens; identical to SEQ ID NO: 896352

SEQ ID NO: 896358 - protein, 383 aa, Homo sapiens; identical to SEQ ID NO: 896352

SEQ ID NO: 896359 - protein, 370 aa, Homo sapiens
ARPRPDQPGLGQPLTGVPVRVLPPRVPAMALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHLCDRAFSRSDHLALHMKRHM

SEQ ID NO: 896360 - protein, 70 aa, Homo sapiens
LGRALRLGTPLGTRLRTLGRECSLGNLERFRVLECWREGACLGPVGEPWLQRVSLDDDDDDATTPAPVCD

SEQ ID NO: 896361 - protein, 371 aa, Homo sapiens
ARPRPDQPGLGQPLTGVPVRVLPPRVPAMALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGGRHARARSAGGGTREERSDSQRAPENEFRTSLGAWLRGIWQVVHA

SEQ ID NO: 896362 - protein, 110 aa, Homo sapiens
HGDRGLRVVKGKQRPPSPAARSRPLPCRPQRWPRAEPESGGTDDDLNSVLDFILSMGLDGLGAEAAPEPPPPPPPPAFYYPEPGAPPPYSAPAGGLVSELLRPELDAPLG

SEQ ID NO: 896363 - protein, 99 aa, Homo sapiens
ADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAA

SEQ ID NO: 896364 - protein, 113 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVK

SEQ ID NO: 896365 - protein, 113 aa, Homo sapiens; identical to SEQ ID NO: 896364

SEQ ID NO: 896366 - protein, 180 aa, Homo sapiens; identical to SEQ ID NO: 875166

SEQ ID NO: 896367 - protein, 160 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKVKYH

SEQ ID NO: 896368 - protein, 395 aa, Homo sapiens [sequence omitted]

SEQ ID NO: 896369 - protein, 375 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 896370 - protein, 160 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKPFPI

SEQ ID NO: 896371 - protein, 346 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKHLTEEKPDGLINEATRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 896372 - protein, 359 aa, Homo sapiens
MYFKRAPRAFPVLLTGAGKTTLLNYILTEQHSKRVAVILNESGEGSALEKSLAVSQGGELYEEWLELRNGCLCCSVKDNGLRAIENLMQKKGKFDDILLETTGLADPGAVASMIWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 896373 - protein, 138 aa, Homo sapiens
EEVRKRAIWMFKNEKSIVTITFDVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 896374 - protein, 177 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIPVTIITGYLGAGKTTLLNYILTEQHSKRVAVILNESGEGSALEKSLAVSQGGELYEEWLELRNGCLCCSVK

SEQ ID NO: 896375 - protein, 104 aa, Homo sapiens
MFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 896376 - protein, 160 aa, Homo sapiens; identical to SEQ ID NO: 896367

SEQ ID NO: 896377 - protein, 395 aa, Homo sapiens [sequence omitted]

SEQ ID NO: 896378 - protein, 395 aa, Homo sapiens [sequence omitted]

SEQ ID NO: 896379 - protein, 160 aa, Homo sapiens; identical to SEQ ID NO: 896367

SEQ ID NO: 896380 - protein, 312 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKHLTEEKPDGLINEATSLQKKLQHVPGTQPHLDQSIVTITFDVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 896381 - protein, 249 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRYFKKAIPINNKSF

SEQ ID NO: 896382 - protein, 1589 aa, Homo sapiens
RRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGRQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVNTLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 896383 - protein, 1589 aa, Homo sapiens; identical to SEQ ID NO: 896382

SEQ ID NO: 896384 - protein, 1589 aa, Homo sapiens; identical to SEQ ID NO: 896382

SEQ ID NO: 896385 - protein, 1174 aa, Homo sapiens
AAAARPTGSRAGGRLQDQSLPPQRQRERAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGRQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPRPARSPLPHARLPHRDLLRLQGLGVLHPLERNLEHPKALEQQGKII

SEQ ID NO: 896386 - protein, 1597 aa, Homo sapiens
RRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGRQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQQEQPSGKQVKTNGISDGKRESPLKIDPFEDLSFNLLAVSKAQLSVQTSPVPTPDPKRLIQLPSATQSNVNTLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 896387 - protein, 1183 aa, Homo sapiens
AAAARPTGSRAGGRLQDQSLPPQRQRERAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGRQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGDNLLFPFLLDVKFFTLF

SEQ ID NO: 896388 - protein, 1183 aa, Homo sapiens; identical to SEQ ID NO: 896387

SEQ ID NO: 896389 - protein, 1568 aa, Homo sapiens
AAAARPTGSRAGGRLQDQSLPPQRQRERAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGRQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVNTLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 896390 - protein, 300 aa, Homo sapiens
VVVVSVKHDPLPLLPEANGHRSTNSPTIVSPAIVSPTQDSRPNMSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIKQEPLD

SEQ ID NO: 896391 - protein, 257 aa, Homo sapiens
MSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIKQEPLD

SEQ ID NO: 896392 - protein, 257 aa, Homo sapiens; identical to SEQ ID NO: 896391

SEQ ID NO: 896393 - protein, 257 aa, Homo sapiens; identical to SEQ ID NO: 896391

SEQ ID NO: 896394 - protein, 257 aa, Homo sapiens; identical to SEQ ID NO: 896391

SEQ ID NO: 896395 - protein, 202 aa, Homo sapiens
MSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDREKIEKVVVSNRLVTSPCCIVTSTYGWTANMERIMKAQALRDNSTMGYMAAKKHLEINPDHSIIETLRQKAE

SEQ ID NO: 896396 - protein, 197 aa, Homo sapiens
AGAGPDFRLVCGVSGSGFPGGRQGQATEWRPLRPWNGAMEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTWYSLSYIPYARDAVIKCCSSLLS

SEQ ID NO: 896397 - protein, 197 aa, Homo sapiens; identical to SEQ ID NO: 896396

SEQ ID NO: 896398 - protein, 144 aa, Homo sapiens
AGAGPDFRLVCGVSGSGFPGGRQGQATEWRPLRPWNGAMEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLV

SEQ ID NO: 896399 - protein, 146 aa, Homo sapiens
AGAGPDFRLVCGVSGSGFPGGRQGQATEWRPLRPWNGAMEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLVSK

SEQ ID NO: 896400 - protein, 67 aa, Homo sapiens
AGAGPDFRLVCGVSGSGFPGGRQGQATEWRPLRPWNGAMEKLRRVLSGQDDEEQGLTAQDSQINLLR

SEQ ID NO: 896401 - protein, 197 aa, Homo sapiens; identical to SEQ ID NO: 896396

SEQ ID NO: 896402 - protein, 79 aa, Homo sapiens
AGAGPDFRLVCGVSGSGFPGGRQGQATEWRPLRPWNGAMEKLRRVLSGQDDEEQGLTAQDSQINLLRSWMPHPLVSTPD

SEQ ID NO: 896403 - protein, 79 aa, Homo sapiens; identical to SEQ ID NO: 896402

SEQ ID NO: 896404 - protein, 175 aa, Homo sapiens
AGAGPDFRLVCGVSGSGFPGGRQGQATEWRPLRPWNGAMEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTW

SEQ ID NO: 896405 - protein, 197 aa, Homo sapiens; identical to SEQ ID NO: 896396

SEQ ID NO: 896406 - protein, 197 aa, Homo sapiens; identical to SEQ ID NO: 896396

SEQ ID NO: 896407 - protein, 97 aa, Homo sapiens
AGAGPDFRLVCGVSGSGFPGGRQGQATEWRPLRPWNGAMEKLRRVLSGQDDEEQGLTAQINTRKMAIGGKNTYYYTNSRAVSLLREKLAIEKQRLNL

SEQ ID NO: 896408 - protein, 197 aa, Homo sapiens; identical to SEQ ID NO: 896396

SEQ ID NO: 896409 - protein, 79 aa, Homo sapiens; identical to SEQ ID NO: 896402

SEQ ID NO: 896410 - protein, 144 aa, Homo sapiens; identical to SEQ ID NO: 896398

SEQ ID NO: 896411 - protein, 183 aa, Homo sapiens
AGAGPDFRLVCGVSGSGFPGGRQGQATEWRPLRPWNGAMEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWVSYVSPTGFQLTVCPPPQLTCHHTIILK

SEQ ID NO: 896412 - protein, 305 aa, Homo sapiens
MSLWVDKYRPCSLGRLDYHKEQAAQLRNLVQCGDFPHLLVYGPSGAGKKTRIMCILRELYGVGVEKLRIEHQTITTPSKKKIEISTIASNYHLEVNPSDAGNSDRVVIQEMLKTVAQSQQLETNSQRDFKVVLLTEVDKLTKDAQHALRRTMEKYMSTCRLILCCNSTSKVIPPIRSRCLAVRVPAPSIEDICHVLSTVCKKEGLNLPSQLAHRLAEKSCRNLRKALLMCEACRVQQYPFTADQEIPETDWEVYLRETANAIVSQQTPQRLLEVRGRLYELLTHCIPPEIIMKACKEESRSCDIF

SEQ ID NO: 896413 - protein, 356 aa, Homo sapiens
MSLWVDKYRPCSLGRLDYHKEQAAQLRNLVQCGDFPHLLVYGPSGAGKKTRIMCILRELYGVGVEKLRIEHQTITTPSKKKIEISTIASNYHLEVNPSDAGNSDRVVIQEMLKTVAQSQQLETNSQRDFKVVLLTEVDKLTKDAQHALRRTMEKYMSTCRLILCCNSTSKVIPPIRSRCLAVRVPAPSIEDICHVLSTVCKKEGLNLPSQLAHRLAEKSCRNLRKALLMCEACRVQQYPFTADQEIPETDWEVYLRETANAIVSQQTPQRLLEVRGRLYELLTHCIPPEIIMKGLLSELLHNCDGQLKGEVAQMAAYYEHRLQLGSKAIYHLEAFVAKFMALYKKFMEDGLEGMMF

SEQ ID NO: 896414 - protein, 1139 aa, Homo sapiens
MQTPEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 896415 - protein, 1290 aa, Homo sapiens
MELSPSSGGAAEALSWPEMFPALESDSPLPPEDLDAVVPVSGAVAGGMLDRILLESVCQQQSWVRVYDVKGPPTHRLSCGQSPYTETTTWERKYCILTDSQLVLLNKEKEIPVEGGQEQQTDSTKGRCLRRTVSVPSEGQFPEYPPEGATKLEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQVINGDEIIQTGKTDRVPGFSQHQTDERADPSEGAVQHAGPQWHLPHQPHQAFHHGEW

SEQ ID NO: 896416 - protein, 973 aa, Homo sapiens
PALWEAEAGGSPEVQEFKNSLTNMVKHLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQVINGDEIIQTGKTDRVPGFSQHQTDERADPSEGAVQHAGPQWHLPHQPHQAFHHGEW

SEQ ID NO: 896417 - protein, 144 aa, Homo sapiens
RCPVNWFSCLSAALCSQENLVPEFSLCLFLSHFMLQGTGLHQPLSNRNCKRMSTPLVSGRSTYPGPCSLGAIGILVVIIRIHFLNIRPENVPPFTPEHEETLWLPGSLYVTQVENREGLPPMRSKSSCLVTVASDISAVLNYRS

SEQ ID NO: 896418 - protein, 186 aa, Homo sapiens
KAAPRRWEGEPPLPGSSASSPGRDPHTPEPGPTLGRGHAGSSSRPGSRPPTAGGLHRPSLGQWATGKEVRGVRAGCRSGPCPRCALSSSPSRRQGAEPRASPPRSRRLVPLPPRGTMELSPSSGGAAEALSWPEMFPALESDSPLPPEDLDAVVPVSGAVAGGMLDRILLESVCQQQSWVRVYGDR

SEQ ID NO: 896419 - protein, 225 aa, Homo sapiens
MELSPSSGGAAEALSWPEMFPALESDSPLPPEDLDAVVPVSGAVAGGMLDRILLESVCQQQSWVRVYDVKGPPTHRLSCGQSPYTETTTWERKYCILTDSQLVLLNKEKEIPVEGGQEQQTDSTKGRCLRRTVSVPSEGQFPEYPPEGATKLEVPAERSPRRRSISGTSTSEKPNSMDTANTSPFKVPGFFSKRLKGSIKRTKSQSKLDRNTSFRLPSLRSTDDR

SEQ ID NO: 896420 - protein, 222 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGCYEL

SEQ ID NO: 896421 - protein, 1168 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896422 - protein, 1086 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896423 - protein, 1248 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVSFPNCLQSKSNLMASSQLIAVNSEQGVEFAVIFNFYVFVVFTLLIFFLIVSKFSAISTLLIITKMKPYVQIVFLVRTFQVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896424 - protein, 377 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKALQRNLKTARHHLKMTKEVQVVLVVAVEAQLKISGLVDFHLIPKLLI

SEQ ID NO: 896425 - protein, 957 aa, Homo sapiens
MPLRESGKPLKDFEEIVDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896426 - protein, 1168 aa, Homo sapiens; identical to SEQ ID NO: 896421

SEQ ID NO: 896427 - protein, 1168 aa, Homo sapiens; identical to SEQ ID NO: 896421

SEQ ID NO: 896428 - protein, 715 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKVSL

SEQ ID NO: 896429 - protein, 1117 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRSWFFILCCLKERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896430 - protein, 1133 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSS

SEQ ID NO: 896431 - protein, 799 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRNVVRKLNGLLEKERNSEGNNSSFVMNKKKGIP

SEQ ID NO: 896432 - protein, 764 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQNDEKSSSRSSGDKKKYE

SEQ ID NO: 896433 - protein, 703 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRIIQEVIPRGPSKGRGGEQAAD

SEQ ID NO: 896434 - protein, 171 aa, Homo sapiens
MPTTNRESSILACRTELRSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896435 - protein, 628 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSK

SEQ ID NO: 896436 - protein, 503 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKRFVFLCQFFTILNSSIQ

SEQ ID NO: 896437 - protein, 290 aa, Homo sapiens
MELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVEGPKIWERSSRAVWEGPPRE

SEQ ID NO: 896438 - protein, 1092 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896439 - protein, 1102 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896440 - protein, 1118 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896441 - protein, 1084 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKEIEAQEGEDDTFLTAQDGEEEENEKEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896442 - protein, 603 aa, Homo sapiens
MSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896443 - protein, 1141 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896444 - protein, 604 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVSFPNCLSKQV

SEQ ID NO: 896445 - protein, 503 aa, Homo sapiens
DLAGITGPRLTCKKKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896446 - protein, 406 aa, Homo sapiens
MELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 896447 - protein, 194 aa, Homo sapiens
AVLDDPFTVLWRIATYEMIEVVKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRNVVRKLNGLLEKERNSEGNNSSFVMNKKKGIP

SEQ ID NO: 896448 - protein, 628 aa, Homo sapiens; identical to SEQ ID NO: 896435

SEQ ID NO: 896449 - protein, 605 aa, Homo sapiens
MSFSARTSLLLKTQDVARKWLTKRRENGGAADVAAVGRARPPSPHKGAHRPSGRGPLDRARRCRSLRQRARAAVIRVLAAAAGCARVADRGRGQRLIVRSAARRRRPPRPGWKLALLPPPCSPLAASAARCSSKMAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKKVIPLRKKCQRP

SEQ ID NO: 896450 - protein, 183 aa, Homo sapiens
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQKIGIVGFCWGGTAVHHLMMKYSEFRAGVSVYGKSALCIFTPCRREGWKSDNNHKPPHPV

SEQ ID NO: 896451 - protein, 245 aa, Homo sapiens
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQKIGIVGFCWGGTAVHHLMMKYSEFRAGVSVYGIVKDSEDIYNLKNPTLFIFAENDVVIPLKDVSLLTQKLKEHCKVEYQIKTFSGQTHGFVHRKREDCSPADKPYIDEARRNLIEWLNKYM

SEQ ID NO: 896452 - protein, 245 aa, Homo sapiens; identical to SEQ ID NO: 896451

SEQ ID NO: 896453 - protein, 227 aa, Homo sapiens
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQMKYSEFRAGVSVYGIVKDSEDIYNLKNPTLFIFAENDVVIPLKDVSLLTQKLKEHCKVEYQIKTFSGQTHGFVHRKREDCSPADKPYIDEARRNLIEWLNKYM

SEQ ID NO: 896454 - protein, 245 aa, Homo sapiens; identical to SEQ ID NO: 896451

SEQ ID NO: 896455 - protein, 245 aa, Homo sapiens; identical to SEQ ID NO: 896451

SEQ ID NO: 896456 - protein, 191 aa, Homo sapiens
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQKIGIVGFCWGGTAVHHLMMKYSEFRAGVSVYGIVKDSEDIYNLKNPTLFIFAENDVVIPLKDPCSWL

SEQ ID NO: 896457 - protein, 115 aa, Homo sapiens
DGVLLCCPELECNGMILAHCNLHLPGSSHSPASATQESEEENHLNLEAEVAVSRGCATALQPGQQRETLSQKKKNLQLFKDQLTGQVWPFLVFEHIIESDKCCKAMKNMNYKRVD

SEQ ID NO: 896458 - protein, 105 aa, Homo sapiens
GSELQEDSNSLKSGVKNAAIQPPFQGKPEMKWAVGFFLFFLSFFGDKVSLQPGQQRETLSQKKKNLQLFKDQLTGQVWPFLVFEHIIESDKCCKAMKNMNYKRVD

SEQ ID NO: 896459 - protein, 68 aa, Homo sapiens
TQAHTSPGPAPLNSRVCSDYGKEGLCRVHGCFAMHFKDIVEITPYANLRSFWPFSTEEPFHHAVKYSL

SEQ ID NO: 896460 - protein, 268 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKCEG

SEQ ID NO: 896461 - protein, 268 aa, Homo sapiens; identical to SEQ ID NO: 896460

SEQ ID NO: 896462 - protein, 268 aa, Homo sapiens; identical to SEQ ID NO: 896460

SEQ ID NO: 896463 - protein, 268 aa, Homo sapiens; identical to SEQ ID NO: 896460

SEQ ID NO: 896464 - protein, 322 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKWSHSVTQAGVQWHNLGSLQPLPLGLKPSSHLSLPRTRIQQRQLLISHQRDHTPKNRL

SEQ ID NO: 896465 - protein, 265 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAK

SEQ ID NO: 896466 - protein, 220 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKVWFYNFRMFFASGSLLLVVHWNCQTDSFSLKQNVLIA

SEQ ID NO: 896467 - protein, 322 aa, Homo sapiens; identical to SEQ ID NO: 896464

SEQ ID NO: 896468 - protein, 220 aa, Homo sapiens; identical to SEQ ID NO: 896466

SEQ ID NO: 896469 - protein, 138 aa, Homo sapiens
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYCL

SEQ ID NO: 896470 - protein, 131 aa, Homo sapiens
FSLFPVKAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKCEG

SEQ ID NO: 896471 - protein, 160 aa, Homo sapiens
MAVFADLDLRAGSDLKALRGLVETAAHRELPRLRAWPTSCHPDHRATLRIGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYCL

SEQ ID NO: 896472 - protein, 220 aa, Homo sapiens; identical to SEQ ID NO: 896466

SEQ ID NO: 896473 - protein, 505 aa, Homo sapiens
MSAEEMVQIRLEDRCYPVSKRKLIEQSNYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDRNMNILQYCPSSDMWTLFETCDVHIRKQQMVSVEETIYIVGGCLHELGPNRRSSQSEDMLTVQSYNTVTRQWLYLKENTSKSGLNLTCALHNDGIYIMSRDVTLSTSLEHRVFLKYNIFSDSWEAFRRFPAFGHNLLVSSLYLPNKAET

SEQ ID NO: 896474 - protein, 487 aa, Homo sapiens
SGGAGAPRAGGEAAGTRALRLPQLRVRSRGARARSFPGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDRNMNILQYCPSSDMWTLFETCDVHIRKQQMVSVEETIYIVGGCLHELGPNRRSSQSEDMLTVQSYNTVTRQWLYLKENTSKSGLNLTCALHNDGIYIMSRDVTLSTSLEHRVFLKYNIFSDSWEAFRRFPAFGHNLLVSSLYLPNKAET

SEQ ID NO: 896475 - protein, 540 aa, Homo sapiens
MSAEEMVQIRLEDRCYPVSKRKLIEQSNYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDSLLEILCCYLSCFLGSAIKNNLLAAQPGFCIKYVDRNMNILQYCPSSDMWTLFETCDVHIRKQQMVSVEETIYIVGGCLHELGPNRRSSQSEDMLTVQSYNTVTRQWLYLKENTSKSGLNLTCALHNDGIYIMSRDVTLSTSLEHRVFLKYNIFSDSWEAFRRFPAFGHNLLVSSLYLPNKAET

SEQ ID NO: 896476 - protein, 147 aa, Homo sapiens [sequence omitted]

SEQ ID NO: 896477 - protein, 147 aa, Homo sapiens [sequence omitted]

SEQ ID NO: 896478 - protein, 505 aa, Homo sapiens; identical to SEQ ID NO: 896473

SEQ ID NO: 896479 - protein, 357 aa, Homo sapiens
MSAEEMVQIRLEDRCYPVSKRKLIEQSNYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRGK

SEQ ID NO: 896480 - protein, 580 aa, Homo sapiens
PLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMISLALCFVLMFGNSMLLTSYYASSLVIIWGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAKQQTHVRKHQFDHGELVYHALQLLAYTALGILIMRLKLFLTPHMCVMASLICSRQLFGWLFCKVHPVAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 896481 - protein, 549 aa, Homo sapiens
PLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKLVICGGSYLNTDTCNNHHFDLGELVYHALQLLAYTALGILIMRLKLFLTPHMCVMASLICSRQLFGWLFCKVHPVAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 896482 - protein, 351 aa, Homo sapiens [sequence omitted]

SEQ ID NO: 896483 - protein, 515 aa, Homo sapiens
MGSLSSRVLRQPRPALAQQAQGARAGGSARRPDTGDDAAGHGFCYCAGSHKRKRSSGSFCYCHPDSETDEDEEEGDEQQRLLNTPRRKKLKSTSKYIYQTLFLNGENSDIKICALGEEWSLHKIYLCQSGYFSSMFSGSWKESSMNIIELEIPDQNIDVEALQVAFGSLYRDDVLIKPSRVVAILAAACLLQLDGLIQQCGETMKETVNVKTVCGYYTSAGTYGLDSVKKKCLEWLLNNLMTHQNVELFKELSINVMKQLIGSSNLFVMQVEMDIYTALKKWMFLQLVPSWNGSLKQLLTETDVWFSKQRKDFEGMAFLETEQGKPFVSVFRHLRLQYIISDLASARIIEQDAVVPSEWLSSVYKQQWFAMLRAEQDSEVGPQEINKEELEGNSMRCGRKLAKDGEYCWRWTGFNFGFDLLVTYTNRYIIFKRNTLNQPCSGSVSLQPRRSIAFRLRLASFDSSGKLICSRTTGYQILTLEKDQEQVVMNLDSRLLIFPLYICCNFLYISPEKKN

SEQ ID NO: 896484 - protein, 121 aa, Homo sapiens
IGHEGAFARIIEQDAVVSERGKNEWLSSVYKQQWFAMLRAEQDSEVGPQEINKEELEGNSMRCGRKLAKDGEYCWRWTGFNFGFDLLVTYTNRYIIFKRNTLNQPCSGSVSLQPRRSIAFR

SEQ ID NO: 896485 - protein, 515 aa, Homo sapiens; identical to SEQ ID NO: 896483

SEQ ID NO: 896486 - protein, 515 aa, Homo sapiens; identical to SEQ ID NO: 896483

SEQ ID NO: 896487 - protein, 515 aa, Homo sapiens; identical to SEQ ID NO: 896483

SEQ ID NO: 896488 - protein, 555 aa, Homo sapiens
MGSLSSRVLRQPRPALAQQAQGARAGGSARRPDTGDDAAGHGFCYCAGSHKRKRSSGSFCYCHPDSETDEDEEEGDEQQRLLNTPRRKKLKSTSKYIYQTLFLNGENSDIKICALGEEWSLHKIYLCQSGYFSSMFSGSWKESSMNIIELEIPDQNIDVEVLLLLPSLVVHMEVPGAIQRQRNTLVKNIYSCNPSTLGGQALQVAFGSLYRDDVLIKPSRVVAILAAACLLQLDGLIQQCGETMKETVNVKTVCGYYTSAGTYGLDSVKKKCLEWLLNNLMTHQNVELFKELSINVMKQLIGSSNLFVMQVEMDIYTALKKWMFLQLVPSWNGSLKQLLTETDVWFSKQRKDFEGMAFLETEQGKPFVSVFRHLRLQYIISDLASARIIEQDAVVPSEWLSSVYKQQWFAMLRAEQDSEVGPQEINKEELEGNSMRCGRKLAKDGEYCWRWTGFNFGFDLLVTYTNRYIIFKRNTLNQPCSGSVSLQPRRSIAFRLRLASFDSSGKLICSRTTGYQILTLEKDQEQVVMNLDSRLLIFPLYICCNFLYISPEKKN

SEQ ID NO: 896489 - protein, 200 aa, Homo sapiens [sequence omitted]

SEQ ID NO: 896490 - protein, 610 aa, Homo sapiens
MPALPAGGGSEDQDEKDVPWKLSVLNHLGLGKPPWLPIVGAWLRTGQPGMWSLGHGATFLQALGPFSVGSKHDTFPNFGSQTTRAAWLRIVPMAWAQSLGGARSAYAQPSLVSTSRFSTPTPRRMRREEEEEELEEEVDELQTTNVSDLGLEHSDPWSSRAAQMALITEQERSVAGRPSGWGGRGHGQEAPRELGPELPQISSLKKGKGDTCSFPTTELQMRTPAPLPWNCRGLCLAGPVEQPVWKDRSEIWTHQIPEDRWHPWPPPTEGLELFTSPALRQIGAVRRVGLCPGADLEGRGETKGELSFIPRSFSAPLTDIQGQEGAPKHNQWPEEWEGLRHHILQIRMGWNPPGSSSSLQGPVSAHSNHGHGRKGWEPQCPSLSPGNQLYAGGLNLWEVKRSPFWVDSKSQGDGRPWARNHMEVTLRPQLSLGDQQNLAPLTTGQWFFTLDVPTFSAPALHRPSEKVKPGYLGIFPARRSPRPSLCSQPGSISLQLPFFILSFREGRRNIGKHLVQWEARGWRRCYIPLPINILNVGEGPENGTQEPAGMPIPHTPPSCSNPAIHSPGGTGAPGRRRRLSTVHPNTYPPTHLPDPLGWHPLLRFPLTPWL

SEQ ID NO: 896491 - protein, 443 aa, Homo sapiens
MTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 896492 - protein, 152 aa, Homo sapiens
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 896493 - protein, 227 aa, Homo sapiens
MTFVKNKPVLNFDLNKKKAKQVLEPLLADANIIRDELFLPETSLLLTPHLSPEEKKESGHVDSAKHLQEVPSGCPMRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 896494 - protein, 56 aa, Homo sapiens
MSAIQNLHSFDPFADGKYFVYLSPGLTYLESSLVPSMLTVMVSGFGVRLLAFKSQF

SEQ ID NO: 896495 - protein, 152 aa, Homo sapiens; identical to SEQ ID NO: 896492

SEQ ID NO: 896496 - protein, 152 aa, Homo sapiens; identical to SEQ ID NO: 896492

SEQ ID NO: 896497 - protein, 152 aa, Homo sapiens; identical to SEQ ID NO: 896492

SEQ ID NO: 896498 - protein, 152 aa, Homo sapiens; identical to SEQ ID NO: 896492

SEQ ID NO: 896499 - protein, 152 aa, Homo sapiens; identical to SEQ ID NO: 896492

SEQ ID NO: 896500 - protein, 152 aa, Homo sapiens; identical to SEQ ID NO: 896492

SEQ ID NO: 896501 - protein, 152 aa, Homo sapiens; identical to SEQ ID NO: 896492

SEQ ID NO: 896502 - protein, 152 aa, Homo sapiens; identical to SEQ ID NO: 896492

SEQ ID NO: 896503 - protein, 152 aa, Homo sapiens; identical to SEQ ID NO: 896492

SEQ ID NO: 896504 - protein, 152 aa, Homo sapiens; identical to SEQ ID NO: 896492

SEQ ID NO: 896505 - protein, 152 aa, Homo sapiens; identical to SEQ ID NO: 896492

SEQ ID NO: 896506 - protein, 140 aa, Homo sapiens [sequence omitted]

SEQ ID NO: 896507 - protein, 134 aa, Homo sapiens
MRLPLSHSPEHVEMALLSNILAAYSFVSVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 896508 - protein, 152 aa, Homo sapiens; identical to SEQ ID NO: 896492

SEQ ID NO: 896509 - protein, 722 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896510 - protein, 109 aa, Homo sapiens
MGAGSFLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896511 - protein, 175 aa, Homo sapiens [sequence omitted]

SEQ ID NO: 896512 - protein, 172 aa, Homo sapiens
GGGGGGSGRRGVRGAPGPGKSRPGAGAASAAVPVRGPLGGLGRGAHVGRGRRALLLAPRSFCLGRGSAPPPPSLHLPGGPRSAAEKGAGPLRREVAAAARRSEARPQGGSGALEASLARLTHPLSAWQPLAGRFVLLGPCSPASLQRPILFAVLCGGGDCGDLGWGCGGVVI

SEQ ID NO: 896513 - protein, 722 aa, Homo sapiens; identical to SEQ ID NO: 896509

SEQ ID NO: 896514 - protein, 752 aa, Homo sapiens
RRRRRRKRPPRGPRRARPGVPGEECDGITSMSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896515 - protein, 722 aa, Homo sapiens; identical to SEQ ID NO: 896509

SEQ ID NO: 896516 - protein, 775 aa, Homo sapiens
RRRRRRKRPPRGPRRARPGVPGEECDGITSMSAESGPGTRLRNLPVMGDGLETSQMSTTQAQAQPQPANAASTNPPPPETSNPNKPKRQTNQLQYLLRVVLKTLWKHQFAWPFQQPVDAVKLNLPEGMVTLGRRDTEVETSCDGVNEKDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896517 - protein, 765 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKFQTTDVIKINPFKYERLWRETLYRTQLLTSAGVVGKNAQKRWEPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896518 - protein, 591 aa, Homo sapiens
MFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896519 - protein, 574 aa, Homo sapiens
MAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896520 - protein, 748 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQRSSSDSDSSTDDSEEERPSGWLSSRSLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896521 - protein, 582 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896522 - protein, 547 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSSLQPSLSPSRTNQRKRRKTRRKRKKKSTKGKRKWKRIKKAKPRNLLLKRRRKIISSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896523 - protein, 382 aa, Homo sapiens
MLAGPVPALRLRTGVMACPPTRVLTKLRAKKPTCSSRHPFRLLPATSPWSHGQTQLTGTCLVFQSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896524 - protein, 412 aa, Homo sapiens
RDVPEGRDKVGRLSLHIRTFLDLLVQEEAQALERWLRGFFPPTRRNSAPPAVCCGTCSETWCLAIVATDACAAPSPSLRKSKTSPLALGAQLPQSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896525 - protein, 621 aa, Homo sapiens
PSQELRAASVVQPQPLVVVKEEKIHSPIIRSEPFSPSLRPEPPKHPESIKAPVHLPQRPEMKPVDVGRPVIRPPEQNAPPPGAPDKDKQKQEPKTPVAPKKDLKIKNMGSWASLVQKHPTTPSSTAKSSSDSFEQFRRAAREKEEREKALKAQAEHAEKEKERLRQERMRSREDEDALEQARRAHEEARRRQEQQQQQRQEQQQQQQQQAAAVAAAATPQAQSSQPQSMLDQQRELARKREQERRRREAMAATIDMNFQSDLLSIFEENLFLSAPRWLLTLIFWQNIDFSIVLGAVVEVGSAAGDASGPGPPACYARGRPDGQLRIAEPVCLTASRTDVPPPTTPHRTSAQHTPCYEQVPAGPKPCIPTCGAEALLSAKCLHSIHRTSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896526 - protein, 281 aa, Homo sapiens
MSFPHQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896527 - protein, 305 aa, Homo sapiens
KEKKKEKKKEKKRKEEVEENKKSKAKEPLKKTKKNNSSNSNVSKKEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896528 - protein, 233 aa, Homo sapiens
MFFGADAWVLGDRKVVSALSVCLACLVYLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 896529 - protein, 720 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETG

SEQ ID NO: 896530 - protein, 776 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETEMAPKSKKKGHPGREQKKHHHHHHQQMQQAPAPVPQQPPPPPQQPPPPPPPQQQQQP

SEQ ID NO: 896531 - protein, 722 aa, Homo sapiens; identical to SEQ ID NO: 896509

SEQ ID NO: 896532 - protein, 766 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQGVLGPPGHGVPSVGTLRVTFPSLLSPLFLRPPPFFFPIIISVFLTQKPPKGCDIALTPRLSVPFYISDWWCLGPLCTLLPAAVF

SEQ ID NO: 896533 - protein, 639 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNRSNGTQAGGGWRGWVLLSQLCPRPPCIPHPLPQQHAVQWASPTTSSDSSYCLGCGLPLSCDSS

SEQ ID NO: 896534 - protein, 568 aa, Homo sapiens
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKLAAANLHPQKARDIHRKE

SEQ ID NO: 896535 - protein, 271 aa, Homo sapiens
PSQELRAASVVQPQPLVVVKEEKIHSPIIRSEPFSPSLRPEPPKHPESIKAPVHLPQRPEMKPVDVGRPVIRPPEQNAPPPGAPDKDKQKQEPKTPVAPKKDLKIKNMGSWASLVQKHPTTPSSTAKSSSDSFEQFRRAAREKEEREKALKAQAEHAEKEKERLRQERMRSREDEDALEQARRAHEEARRRQEQQQQQRQEQQQQQQQQAAAVAAAATPQAQSSQPQSMLDQQRELARKREQERRRREAMAATIDMNFQSDLLSIFEENLF

SEQ ID NO: 896536 - protein, 271 aa, Homo sapiens; identical to SEQ ID NO: 896535

SEQ ID NO: 896537 - protein, 271 aa, Homo sapiens; identical to SEQ ID NO: 896535

SEQ ID NO: 896538 - protein, 271 aa, Homo sapiens; identical to SEQ ID NO: 896535

SEQ ID NO: 896539 - protein, 271 aa, Homo sapiens; identical to SEQ ID NO: 896535

SEQ ID NO: 896540 - protein, 271 aa, Homo sapiens; identical to SEQ ID NO: 896535

SEQ ID NO: 896541 - protein, 271 aa, Homo sapiens; identical to SEQ ID NO: 896535

SEQ ID NO: 896542 - protein, 55 aa, Homo sapiens
MGDGLETSQMSTTQAQAQPQPANAASTNPPPPETSRREPHQWRSGHHHLHLIAIP

SEQ ID NO: 896543 - protein, 627 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896544 - protein, 215 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQQKSDWFESAPASVPVSLGVRPEGE

SEQ ID NO: 896545 - protein, 241 aa, Homo sapiens
MSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDRIEVCGLDSVPHRSFFSLS

SEQ ID NO: 896546 - protein, 216 aa, Homo sapiens
RLGARPGGDDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRR

SEQ ID NO: 896547 - protein, 627 aa, Homo sapiens; identical to SEQ ID NO: 896543

SEQ ID NO: 896548 - protein, 627 aa, Homo sapiens; identical to SEQ ID NO: 896543

SEQ ID NO: 896549 - protein, 627 aa, Homo sapiens; identical to SEQ ID NO: 896543

SEQ ID NO: 896550 - protein, 627 aa, Homo sapiens; identical to SEQ ID NO: 896543

SEQ ID NO: 896551 - protein, 627 aa, Homo sapiens; identical to SEQ ID NO: 896543

SEQ ID NO: 896552 - protein, 627 aa, Homo sapiens; identical to SEQ ID NO: 896543

SEQ ID NO: 896553 - protein, 627 aa, Homo sapiens; identical to SEQ ID NO: 896543

SEQ ID NO: 896554 - protein, 627 aa, Homo sapiens; identical to SEQ ID NO: 896543

SEQ ID NO: 896555 - protein, 451 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPFSHWP

SEQ ID NO: 896556 - protein, 627 aa, Homo sapiens; identical to SEQ ID NO: 896543

SEQ ID NO: 896557 - protein, 619 aa, Homo sapiens
MIDDSQTHASAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896558 - protein, 627 aa, Homo sapiens; identical to SEQ ID NO: 896543

SEQ ID NO: 896559 - protein, 478 aa, Homo sapiens
MFCVSASSQSKMEKYRPHQSHANQNGPSTYGAGLIEWTTAGVENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896560 - protein, 627 aa, Homo sapiens; identical to SEQ ID NO: 896543

SEQ ID NO: 896561 - protein, 306 aa, Homo sapiens
MSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896562 - protein, 487 aa, Homo sapiens
MFCVSASSQSKMEKYRPHQSHANQNGPSTYGAGLIEWTTAGVENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKLTDFYSNIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896563 - protein, 342 aa, Homo sapiens
RLGARPGGDDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896564 - protein, 370 aa, Homo sapiens
MTACLPFPPHIGSSRVAEGPAAAATTTTTAATSVLTSDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAEKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 896565 - protein, 547 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYQLNISKEIVVADSNDDLFVTGDMNYEERKSLLSVQTQYKRGGLTH

SEQ ID NO: 896566 - protein, 165 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCK

SEQ ID NO: 896567 - protein, 149 aa, Homo sapiens
MMTKHKKCFIIVGVLITTNIITLIVKLTRDSQSLCPYDWIGFQNKCYYFSKEEGDWNSSKYNCSTQHADLTIIDNIEETNFLRRYKCSSDHWIGLKMAKNRTGQWVDGATFTKSFGMRGSEGCAYLSDDGAATARCYTERKWICRKRIH

SEQ ID NO: 896568 - protein, 149 aa, Homo sapiens
MMTKHKKCFIIVGVLITTNIITLIVKLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 896569 - protein, 149 aa, Homo sapiens; identical to SEQ ID NO: 896567

SEQ ID NO: 896570 - protein, 149 aa, Homo sapiens; identical to SEQ ID NO: 896568

SEQ ID NO: 896571 - protein, 149 aa, Homo sapiens; identical to SEQ ID NO: 896567

SEQ ID NO: 896572 - protein, 745 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896573 - protein, 190 aa, Homo sapiens
SGALLMTNREGGEALKASGERIRDEVFDPGVDGHGHYRTSLIACPHDSDRLPRLRTVSAASSCMLVSDKVELGPVVFTTETDAFPVTTQGSQQTQPPQKHYGITSPISLAAPKETDCVLTQKLIETLKPFGVFEEEEELQRRILILGKLNNLVKEWIREISESKVLILMRCVLHQDMLIEVTFSPHSMIS

SEQ ID NO: 896574 - protein, 745 aa, Homo sapiens; identical to SEQ ID NO: 896572

SEQ ID NO: 896575 - protein, 745 aa, Homo sapiens; identical to SEQ ID NO: 896572

SEQ ID NO: 896576 - protein, 745 aa, Homo sapiens; identical to SEQ ID NO: 896572

SEQ ID NO: 896577 - protein, 724 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEEQLDTETSTTQSETIQTAASLLASQKTSSTDLSDIPALPANPIPVIKNSIKLRLNR

SEQ ID NO: 896578 - protein, 699 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEKTSSTDLSDIPALPANPIPVIKNSIKLRLNR

SEQ ID NO: 896579 - protein, 390 aa, Homo sapiens [sequence omitted]

SEQ ID NO: 896580 - protein, 712 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLYAYNYTSIPTTEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896581 - protein, 745 aa, Homo sapiens; identical to SEQ ID NO: 896572

SEQ ID NO: 896582 - protein, 749 aa, Homo sapiens
VSNFVYSPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896583 - protein, 757 aa, Homo sapiens
MPLRSSLGDRARLKNPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896584 - protein, 826 aa, Homo sapiens
SGALLMTNREGGEALKASGERIRDEVFDPEVLMVMATTAHLSSPALTIRIDCDCGQCQPRSQCMLVSDKVELGPVVFTTETEPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896585 - protein, 750 aa, Homo sapiens
PLVPIDSGLSLLSGPGSPVSPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896586 - protein, 680 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEMKQVKMLTVCFE

SEQ ID NO: 896587 - protein, 555 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQG

SEQ ID NO: 896588 - protein, 580 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVLLVFFKSYFVNR

SEQ ID NO: 896589 - protein, 285 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWYVFRLY

SEQ ID NO: 896590 - protein, 285 aa, Homo sapiens; identical to SEQ ID NO: 896589

SEQ ID NO: 896591 - protein, 317 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVSVLFFPLPIHTVQ

SEQ ID NO: 896592 - protein, 390 aa, Homo sapiens [sequence omitted]

SEQ ID NO: 896593 - protein, 149 aa, Homo sapiens
GDLEDPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 896594 - protein, 285 aa, Homo sapiens; identical to SEQ ID NO: 896589

SEQ ID NO: 896595 - protein, 238 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGMRKPTSFCVLQFLSDISCFYTSFVLKLFIAILLTQ

SEQ ID NO: 896596 - protein, 185 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDMLSADLACRPFLKIGSTR

SEQ ID NO: 896597 - protein, 112 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGC

SEQ ID NO: 896598 - protein, 361 aa, Homo sapiens; identical to SEQ ID NO: 749354

SEQ ID NO: 896599 - protein, 252 aa, Homo sapiens
MGQAGGPWDRENFNEWVPLFPQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 896600 - protein, 243 aa, Homo sapiens
WAFAEPRTFLTPRITPRDTHSKQQPGKRTKKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 896601 - protein, 263 aa, Homo sapiens
MASLLAKDAYLQSLAKKICSHSAPEQQARTRAGKTQGSETAGPPKKKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTLTEDYGSGEAEDRNRWKWRQRGSANGGNNGPPKG

SEQ ID NO: 896602 - protein, 238 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQVSFSI

SEQ ID NO: 896603 - protein, 248 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGKETVTREVKGFTESRGFPLFCDIFVVIIFVLWIGKLSRD

SEQ ID NO: 896604 - protein, 269 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 896605 - protein, 269 aa, Homo sapiens; identical to SEQ ID NO: 896604

SEQ ID NO: 896606 - protein, 269 aa, Homo sapiens; identical to SEQ ID NO: 896604

SEQ ID NO: 896607 - protein, 294 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQRQSLALLPRLECSGSILAHCNVCLPGSSDSRASASPVAGTTGTHHHARVTCIFSRDGVSPF

SEQ ID NO: 896608 - protein, 274 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQRQGLALLPRLECSGVIITHCSLEFLGSNNLPASAPIQYGIF

SEQ ID NO: 896609 - protein, 131 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPFPVFQHPT

SEQ ID NO: 896610 - protein, 179 aa, Homo sapiens
ADEHEFMDSGLALLLDEVDEPMVEAVVRGHLSTAIKLRLYFLSQLLSQLHSPLVKAVDVPDDALNEDLVLIHGDQGSKHEWCELGEHNRVGWAISFKDLMWQQPLKVLWTLARSLELLSGLLRRFSPHQGLCLGQEVGQEDLVMQTLPYGVLGLDRDEEVTGYHLGALILCNREILYIM

SEQ ID NO: 896611 - protein, 131 aa, Homo sapiens; identical to SEQ ID NO: 896609

SEQ ID NO: 896612 - protein, 148 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPPLWRTPPHGGEVELGSQFPVFQHPT

SEQ ID NO: 896613 - protein, 308 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPPPHGGEGLTLSPWLEYIGTDLSSLQPPPPGFSQFSCLSLLSSWDYMACATHPVSCFPAPNITCKDSSGNETHFTGNEVGFFKPISCRNVNGYSYKVAVALSLFLGWLGADRFYLGYPALGLLKFCTVGFCGIGSLIDFILISMQRQGLALLPRLECSGVIITHCSLEFLGSNNLPASAPIQYGIF

SEQ ID NO: 896614 - protein, 176 aa, Homo sapiens
RFAKCEDLKAGQYPLWRTPPHGGEVELGSQKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 896615 - protein, 216 aa, Homo sapiens
MHILKGSPNVIPRAHGQKNTRRDGTGLYPMRGPFKNLALLPFSLPLLGGGGSGSGEKVSVSKMAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALDCWTFRWK

SEQ ID NO: 896616 - protein, 1124 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 896617 - protein, 199 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQSTV

SEQ ID NO: 896618 - protein, 158 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKFPANDPKAGTQGKCMPFFRAGFVCPSPPYKSLAREQINALTSFLDASFVYSSEPSLASRLRKLSSPLGLM

SEQ ID NO: 896619 - protein, 1181 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896620 - protein, 1162 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896621 - protein, 1181 aa, Homo sapiens; identical to SEQ ID NO: 896619

SEQ ID NO: 896622 - protein, 1181 aa, Homo sapiens; identical to SEQ ID NO: 896619

SEQ ID NO: 896623 - protein, 1115 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGTQMPLVSSRILFTTRKHNYFRRRE

SEQ ID NO: 896624 - protein, 955 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896625 - protein, 751 aa, Homo sapiens
TQQVLGTLLEENMLPLPSCHTPDQAPKQQSSGSCTRASGPLPWPLALGPLVLVPSHGGNEKGAPGQTVWRFLQSLTACALLLAESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896626 - protein, 648 aa, Homo sapiens
MEFCHVGQPGLELSSSDLPASASQNCWDYSNFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896627 - protein, 516 aa, Homo sapiens
PQVCFLISRFQDPTISVPFQPLQPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896628 - protein, 332 aa, Homo sapiens
PIKWRGQQLLLRVTGILQCPNLCKMPEVSCKASLSPVEENSERKLIYLKCMLIPLFLKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 896629 - protein, 1181 aa, Homo sapiens; identical to SEQ ID NO: 896619

SEQ ID NO: 896630 - protein, 1103 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 896631 - protein, 1181 aa, Homo sapiens; identical to SEQ ID NO: 896619

SEQ ID NO: 896632 - protein, 1181 aa, Homo sapiens; identical to SEQ ID NO: 896619

SEQ ID NO: 896633 - protein, 1103 aa, Homo sapiens; identical to SEQ ID NO: 896630

SEQ ID NO: 896634 - protein, 713 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEVCVHSVALNRGSFPDNQWPQAASLW

SEQ ID NO: 896635 - protein, 340 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINVRTSWLRFPDFATWAGDISRCEGR

SEQ ID NO: 896636 - protein, 163 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISEWSLW

SEQ ID NO: 896637 - protein, 1181 aa, Homo sapiens; identical to SEQ ID NO: 896619

SEQ ID NO: 896638 - protein, 950 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKVVVLNNLLSLFPACSQMFSCST

SEQ ID NO: 896639 - protein, 199 aa, Homo sapiens; identical to SEQ ID NO: 896617

SEQ ID NO: 896640 - protein, 91 aa, Homo sapiens
VMLEVTKSLSPLSPLQCLIVGGGPCGLRTAIELAYLGAKVVVVEKRDSFSRNNVLHLWPFTIHDLRGLGAKKFYGKFCAGSIDHISEWSLW

SEQ ID NO: 896641 - protein, 399 aa, Homo sapiens
MAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 896642 - protein, 439 aa, Homo sapiens
GSWSPRRSPGEGSGLVRLRQPVAFWESKFRRFMRSLFRCSRTDYKTLDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 896643 - protein, 142 aa, Homo sapiens
MATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 896644 - protein, 399 aa, Homo sapiens; identical to SEQ ID NO: 896641

SEQ ID NO: 896645 - protein, 198 aa, Homo sapiens
GRSNIRRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 896646 - protein, 410 aa, Homo sapiens
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEGATQRALNAPHNEPHNEPVP

SEQ ID NO: 896647 - protein, 329 aa, Homo sapiens
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDRSMSESFRAGSLDDDT

SEQ ID NO: 896648 - protein, 120 aa, Homo sapiens
MAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPEQ

SEQ ID NO: 896649 - protein, 399 aa, Homo sapiens; identical to SEQ ID NO: 896641

SEQ ID NO: 896650 - protein, 273 aa, Homo sapiens
MKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 896651 - protein, 399 aa, Homo sapiens; identical to SEQ ID NO: 896641

SEQ ID NO: 896652 - protein, 399 aa, Homo sapiens; identical to SEQ ID NO: 896641

SEQ ID NO: 896653 - protein, 84 aa, Homo sapiens
SWVSLDEHIMVESGDDSWDLITCYCRKPFAGRPMIECSLCGTWIHLSCAKIKKTNVPDFFYCQKCKELRPEARRLGGPPKSGEP

SEQ ID NO: 896654 - protein, 109 aa, Homo sapiens
MASEDNRVPSPPPTGDDGGGGGREETPTEGGALSLKPGLPIRGIRMKFAVLTGLVEVGEVSNRDIVETVFNLVVHEYFISIYSFQWVGEQDLKAGAMWFTHTDGDFFRV

SEQ ID NO: 896655 - protein, 2863 aa, Homo sapiens
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDGSEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHVCIFKLRENSKATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896656 - protein, 2687 aa, Homo sapiens
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDGSEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGYSLLNCKFCSCMAAKNKPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896657 - protein, 2687 aa, Homo sapiens; identical to SEQ ID NO: 896656

SEQ ID NO: 896658 - protein, 2687 aa, Homo sapiens; identical to SEQ ID NO: 896656

SEQ ID NO: 896659 - protein, 2762 aa, Homo sapiens
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDGSEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGPSS

SEQ ID NO: 896660 - protein, 845 aa, Homo sapiens
RARHPKIIVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGYSLLNCKFCSCMAAKNKPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896661 - protein, 578 aa, Homo sapiens
MILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGYSLLNCKFCSCMAAKNKPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896662 - protein, 2790 aa, Homo sapiens
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDGSEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRVHHFWHGFRKHCAILQRL

SEQ ID NO: 896663 - protein, 2687 aa, Homo sapiens; identical to SEQ ID NO: 896656

SEQ ID NO: 896664 - protein, 2687 aa, Homo sapiens; identical to SEQ ID NO: 896656

SEQ ID NO: 896665 - protein, 405 aa, Homo sapiens
RRSRGSLAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896666 - protein, 402 aa, Homo sapiens
MGTCAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896667 - protein, 318 aa, Homo sapiens
AKPLFNYKITHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 896668 - protein, 24 aa, Homo sapiens
MASGSIVLFYNDFNRWHHEYQTRY

SEQ ID NO: 896669 - protein, 191 aa, Homo sapiens
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQQVFYCFSAPRGNETSVLFQRLYGPQALLFSLFWPTFLLTGGLLIIAMVKSNQYLSILAAQK

SEQ ID NO: 896670 - protein, 191 aa, Homo sapiens; identical to SEQ ID NO: 896669

SEQ ID NO: 896671 - protein, 166 aa, Homo sapiens
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQPGGPASPLCPDKWYGMDGWLSSGPPGCTGTGALTIR

SEQ ID NO: 896672 - protein, 345 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 896673 - protein, 356 aa, Homo sapiens
DAWVDPRVRAAMQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 896674 - protein, 293 aa, Homo sapiens
RVPHWMLRQEFEISLGNIASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 896675 - protein, 327 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQGQGSSTNGMFPGDSPLNLSPLQYSNAFDVFAAYGGLNEKSFVDGLNFSLNNMQYSNQQFQPVMAN

SEQ ID NO: 896676 - protein, 322 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 896677 - protein, 216 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDL

SEQ ID NO: 896678 - protein, 202 aa, Homo sapiens
MPPRSSPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDL

SEQ ID NO: 896679 - protein, 603 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896680 - protein, 651 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896681 - protein, 135 aa, Homo sapiens
MPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896682 - protein, 640 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896683 - protein, 592 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896684 - protein, 154 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTGGESGRLRRQGQVKVSAIGGFTLVHQRVW

SEQ ID NO: 896685 - protein, 603 aa, Homo sapiens; identical to SEQ ID NO: 896679

SEQ ID NO: 896686 - protein, 603 aa, Homo sapiens; identical to SEQ ID NO: 896679

SEQ ID NO: 896687 - protein, 494 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896688 - protein, 636 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAAQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896689 - protein, 494 aa, Homo sapiens; identical to SEQ ID NO: 896687

SEQ ID NO: 896690 - protein, 361 aa, Homo sapiens
MAVKDTGERLSHAVGCAFAACLERKQKREKECGVTATFDASRTTFTREGSFRVTTATEQAEREEIMKQMQDAKKVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896691 - protein, 434 aa, Homo sapiens
IIFFFRLSLLGLKRRESSQRRRDGVVGERAVPDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 896692 - protein, 254 aa, Homo sapiens [sequence omitted]

SEQ ID NO: 896693 - protein, 603 aa, Homo sapiens; identical to SEQ ID NO: 896679

SEQ ID NO: 896694 - protein, 603 aa, Homo sapiens; identical to SEQ ID NO: 896679

SEQ ID NO: 896695 - protein, 548 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGFVCSNCHFIFTLLDMGTVWV

SEQ ID NO: 896696 - protein, 393 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGWCPLTCSAVLFTTSTFSTLLTNCKLAS

SEQ ID NO: 896697 - protein, 1383 aa, Homo sapiens
MGWYFRLQQAPPHSAGRCRRVPGARYFPEPPPPAPGPRTSADTTMDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKDACQTLLKRLEPIISKNPKGTWKDWLAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 896698 - protein, 154 aa, Homo sapiens
VRARAEFGTSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 896699 - protein, 1383 aa, Homo sapiens; identical to SEQ ID NO: 896697

SEQ ID NO: 896700 - protein, 1358 aa, Homo sapiens
MGWYFRLQQAPPHSAGRCRRVPGARYFPEPPPPAPGPRTSADTTMDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKLAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 896701 - protein, 1046 aa, Homo sapiens
MGWYFRLQQAPPHSAGRCRRVPGARYFPEPPPPAPGPRTSADTTMDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFKWSAVN

SEQ ID NO: 896702 - protein, 1369 aa, Homo sapiens
MGWYFRLQQAPPHSAGRCRRVPGARYFPEPPPPAPGPRTSADTTMDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQLRGTSTETVPNANISGGSVVADLNGLAVKDACQTLLKRLEPIISKNPKGTWKDWLAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 896703 - protein, 838 aa, Homo sapiens
TKQKFIGRKMADGRQDLDSGILNFSSRSVTKTLLSLPELVTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKLAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 896704 - protein, 1383 aa, Homo sapiens; identical to SEQ ID NO: 896697

SEQ ID NO: 896705 - protein, 247 aa, Homo sapiens
HERHERHEDACQTLLKRLEPIISKNPKGTWKDWLAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 896706 - protein, 1358 aa, Homo sapiens; identical to SEQ ID NO: 896700

SEQ ID NO: 896707 - protein, 1001 aa, Homo sapiens
MGWYFRLQQAPPHSAGRCRRVPGARYFPEPPPPAPGPRTSADTTMDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSYKQEINAKNLIQCWRECMAMSSYSLRKVAVEKFKFRVFRYP

SEQ ID NO: 896708 - protein, 1370 aa, Homo sapiens
MGWYFRLQQAPPHSAGRCRRVPGARYFPEPPPPAPGPRTSADTTMDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKLAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMGAHGKPVRRTQEQVLLIQLHKIQPMLVA

SEQ ID NO: 896709 - protein, 72 aa, Homo sapiens
NAKNLIQCWRECMAMSSYSLRKVAVEKFNAENYWKKKGLAMVPLKFPVGLGSRAAGQVSSPNAHEDAAWKQP

SEQ ID NO: 896710 - protein, 239 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 896711 - protein, 239 aa, Homo sapiens; identical to SEQ ID NO: 896710

SEQ ID NO: 896712 - protein, 254 aa, Homo sapiens
RERFQSGYFWGTRKAPSERSRRFFPLRFSPELTGAARSELIRGSLPGPGGRSASRPEPRGEEAGRGLRDAQTPRHRRPPPTRLAVAEPWRLLKAAAPPRPPRPPVRPQTLPTAGSPPPRRSVVEPRACEERAARQLPASRPASPRSRVLRSAAMASEELACKLERRLRREEAEESGPQLAPLGAPAPEPKPEPEPPARAPTASADAELSAQLSRRLDINEGAARPRRCRVFNPYTEFPEFSRRLIKDLESMFKL

SEQ ID NO: 896713 - protein, 124 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLIPPVPPSSPCSVYVFPAQPFPHS

SEQ ID NO: 896714 - protein, 239 aa, Homo sapiens; identical to SEQ ID NO: 896710

SEQ ID NO: 896715 - protein, 265 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLICNGDVMDVLPVPESRVTKTPVKPKKYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 896716 - protein, 127 aa, Homo sapiens
MELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 896717 - protein, 151 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKMRTSMASSASGSSCSFSTRPRQGSCRRTVG

SEQ ID NO: 896718 - protein, 154 aa, Homo sapiens
LKGWKCMRRRNKNMCVWTGAAALAEPTVPILMDRLLAADPGTVLLGLEPWTLGFGSEREKSFMGCLLPAFLGAAAGELQEDSGLMALAKLSEIDVALEGVKGAKNFFEAKVQALSSASKFEAELKAEQDERKREEEERRLRQAAFQKLKANFNT

SEQ ID NO: 896719 - protein, 239 aa, Homo sapiens; identical to SEQ ID NO: 896710

SEQ ID NO: 896720 - protein, 192 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGQLPCQPSFLPVSKPLQEGPGVGQMPAHLCLLPLLLCPSYSQNLYLLSNLHFVLVPLPFPIKE

SEQ ID NO: 896721 - protein, 198 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVGA

SEQ ID NO: 896722 - protein, 278 aa, Homo sapiens
GSTWGPGRGRGCGCSHFPRLQPAQAAAAAAGEPRPRKAMKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 896723 - protein, 278 aa, Homo sapiens; identical to SEQ ID NO: 896722

SEQ ID NO: 896724 - protein, 258 aa, Homo sapiens
GSTWGPGRGRGCGCSHFPRLQPAQAAAAAAGEPRPRKAMKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELSARAGSSGSGEVGASRD

SEQ ID NO: 896725 - protein, 145 aa, Homo sapiens
MDSGTVLFEIKKPPVSERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 896726 - protein, 442 aa, Homo sapiens
GSTWGPGRGRGCGCSHFPRLQPAQAAAAAAGEPRPRKAMKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSGEWAGWAIDGEADRSCGVGCPGNPWATEESTELGLGPQHSQESAGRGALSFPSHMFLRLDILRGQPYPFGPCQPALCRALWELQSYGSQASASCGPGKHSGDWEHADLEPLGGYYLANGLSPQCAPEFLGEFKKKSDRWGPKGRTLGGQGPSLKPTEPQLGYIAERLPINRRDLDPNAGRFVRYQFTPAFLRLRQVGATVEFTVGDKPVNNFRMIERHYFRNQLLKSFDFHFGFCIPSSKNTCEHIYDFPPLSEELISEMIRHPYETQSDSFYFVDDRLVMHNKADYSYSGTP

SEQ ID NO: 896727 - protein, 278 aa, Homo sapiens; identical to SEQ ID NO: 896722

SEQ ID NO: 896728 - protein, 268 aa, Homo sapiens
GSTWGPGRGRGCGCSHFPRLQPAQAAAAAAGEPRPRKAMKVKKGGGGAGTATESAPGPSGQSVAPIPQPPAESESGSESEPDAGPGPRPGPLQRKQPIGPEDVLGLQRITGDYLCSPEENIYKIDFVRFKIRDMDSGTVLFEIKKPPVSGEWAGWAIDGEADRSCGVGCPGNPWATEESTELGLGPQHSQESAGRGALSFPSHMFLRLDILRGQPYPFGPCQPALCRALWELQSYGSQASASCGPGKHSGDWEHADLEPLGGTIWPMV

SEQ ID NO: 896729 - protein, 441 aa, Homo sapiens
MVHIKKGELTQEEKELLEVIGKGTVQEAGTLLSSKNVRVNCLDENGMTPLMHAAYKGKLDMCKLLLRHGADVNCHQHEHGYTALMFAALSGNKDITWVMLEAGAETDVVNSVGRTAAQMAAFVGQHDCVTIINNFFPRERLDYYTKPQGLDKEPKLPPKLAGPLHKIITTTNLHPVKIVMLVNENPLLTEEAALNKCYRVMDLICEKCMKQRDMNEVLAMKMHYISCIFQKCINFLKDGENKLDTLIKSLLKGRASDGFPVYQEKIIRESIRKFPYCEATLLQQLVRSIAPVEIGSDPTAFSVLTQAITGQVGFVDVEFCTTCGEKGASKRCSVCKMVIYCDQTCQKTHWFTHKKICKNLKDIYEKQQLEAAKEKRQEENHGKLDVNSNCVNEEQPEAEVGISQKDSNPEDSGEGKKESLESEAELEGLQDAPAGPQVSEE

SEQ ID NO: 896730 - protein, 341 aa, Homo sapiens
MVHIKKGELTQEEKELLEVIGKGTVQEAGTLLSSKNVRVNCLDENGMTPLMHAAYKGKLDMCKLLLRHGADVNCHQHEHGYTALMFAALSGNKDITWVMLEAGAETDVVNSVGRTAAQMAAFVGQHDCVTIINNFFPRERLDYYTKPQGLDKEPKLPPKLAGPLHKIITTTNLHPVKIVMLVNENPLLTEEAALNKCYRVMDLICEKCMKQRDMNEVLAMKMHYISCIFQKCINFLKDGENKLDTLIKSLLKGRASDGFPVYQEKIIRESIRKFPYCEATLLQQLVRSIAPVEIGSDPTAFSVLTQAITGQVGFVDVEFCTTCGEKGASKRCSVCKMCREL

SEQ ID NO: 896731 - protein, 292 aa, Homo sapiens
MVHIKKGELTQEEKELLEVIGKGTVQEAGTLLSSKNVRVNCLDENGMTPLMHAAYKGKLDMCKLLLRHGADVNCHQHEHGYTALMFAALSGNKDITWVMLEAGAETDVVNSVGRTAAQMAAFVGQHDCVTIINNFFPRERLDYYTKPQGLDKEPKLPPKLAGPLHKIITTTNLHPVKIVMLVNENPLLTEEAALNKCYRVMDLICEKCMKQRDMNEVLAMKMHYISCIFQKCINFLKDGENKLDTLIKRVLIPLHSPSLPKPSLARWVLWMWNFALPVEKREQVKDVQFAKW

SEQ ID NO: 896732 - protein, 441 aa, Homo sapiens; identical to SEQ ID NO: 896729

SEQ ID NO: 896733 - protein, 441 aa, Homo sapiens; identical to SEQ ID NO: 896729

SEQ ID NO: 896734 - protein, 335 aa, Homo sapiens
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 896735 - protein, 335 aa, Homo sapiens; identical to SEQ ID NO: 896734

SEQ ID NO: 896736 - protein, 247 aa, Homo sapiens
MPRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 896737 - protein, 150 aa, Homo sapiens
MKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 896738 - protein, 335 aa, Homo sapiens; identical to SEQ ID NO: 896734

SEQ ID NO: 896739 - protein, 257 aa, Homo sapiens
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEASATRRD

SEQ ID NO: 896740 - protein, 268 aa, Homo sapiens
GSGRNSVVLRARLPAAAQRQPAGQFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 896741 - protein, 335 aa, Homo sapiens; identical to SEQ ID NO: 896734

SEQ ID NO: 896742 - protein, 394 aa, Homo sapiens
GAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDEGALGHHV

SEQ ID NO: 896743 - protein, 370 aa, Homo sapiens
GAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRSSHCAPFSVLCHPEPQCSSSSMCSAQPS

SEQ ID NO: 896744 - protein, 385 aa, Homo sapiens
GRAVSGPRALGGSAARSVGAYSRAVWRQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDEGALGHHV

SEQ ID NO: 896745 - protein, 258 aa, Homo sapiens
VDGDSRSCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDEGALGHHV

SEQ ID NO: 896746 - protein, 432 aa, Homo sapiens
GAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFILWLDANQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGLSGTTCKVMCPYQEVRENTFLVKKKHFRCMISCVFILGGAIHF

SEQ ID NO: 896747 - protein, 194 aa, Homo sapiens
MKAIHNKVNIVPVIAKADTLTLKERERLKKRILDEIEEHNIKIYHLPDAESDEDEDFKEQTRLLKASIPSPVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDEGALGHHV

SEQ ID NO: 896748 - protein, 742 aa, Homo sapiens
MVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAMVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKRLQEKAIEASRYHKRPQNAIFHQTHIKGLNTMVPSGGVVTVESTPARLVGGPLVDTDIALKKLPIRGGALQRVKAVKIVDAPKKSIPT

SEQ ID NO: 896749 - protein, 707 aa, Homo sapiens
MVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAMVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKVPSGGVVTVESTPARLVGGPLVDTDIALKKLPIRGGALQRVKAVKIVDAPKKSIPT

SEQ ID NO: 896750 - protein, 370 aa, Homo sapiens
MVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAMVYLEDETVNKDLCEKGTIQQMIGIFKNIISKPNEKEEAIVLEIQSDILLILSGLCENHIQRKVCMPVKVLFRSPSHLTL

SEQ ID NO: 896751 - protein, 696 aa, Homo sapiens
MVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAMVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDFENLPGLSAEDFVTLCIIHRYLDFKIGEIWNEIYEEIKLEKLRPVTTDKKALEAITTASENIGKMVASLQSDIIESQACQDMQNEQKVYAKIQATHKQRELANKSWEDFLARTSNAKTLKKAKRLQEKAIEASRYHKRPQNAIFHQTHIKGLNTMVPSGGVVTVESTPARLVGGPLVDTDIALKKLPIRGGALQRVKAVKIVDAPKKSIPT

SEQ ID NO: 896752 - protein, 676 aa, Homo sapiens
MVQSMTLLENQLVEKLWVLKVLQHLSTSEVNCTIMMKAQAASGICTHLNDPDPSGQLLFRSSEILWNLLEKSSKEEVIQQLSNLECLLALKEVFKNLFMRGFSHYDRQLRNDILVITTIIAQNPEAPMIECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYMSCQGNARVLAFLEWCESEDPFFSHGNSFHGTGGRGNKFAQMRYSLRLLRAMVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKIQATHKQRELANKSWEDFLARTSNAKTLKKAKRLQEKAIEASRYHKRPQNAIFHQTHIKGLNTMVPSGGVVTVESTPARLVGGPLVDTDIALKKLPIRGGALQRVKAVKIVDAPKKSIPT

SEQ ID NO: 896753 - protein, 1242 aa, Homo sapiens
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLHSNSLENPTKPVPSSTITNSAVQSTSNASTMSVSSKVTKPIPRSESCSQPVMNGKSKLNSSVLVPYGAESSEDSDEESKGLGKENGIGTIVSSHSPGQDAEDEEATPHELQEPMTLNGANSADSDSDPKENGLAPDGASCQGQPALHSENPFAKANGLPGKLMPAPLLSLPEDKILETFRLSNKLKGSTDEMSAPGAERGPPEDRDAEPQPGSPAAESLEEPDAAAGLSSTKKAPPPRDPGTPATKEGAWEAMAVAPEEPPPSAGEDIVGDTAPPDLCDPGSLTGDASPLSQDAKGMIAEGPRDSALAEAPEGLSPAPPARSEEPCEQPLLVHPSGDHARDAQDPSQSLGAPEAAERPPAPVLDMAPAGHPEGDAEPSPGERVEDAAAPKAPGPSPAKEKIGSLRKVDRGHYRSRRERSSSGEPARESRSKTEGHRHRRRRTCPRERDRQDRHAPEHHPGHGDRLSPGERRSLGRCSHHHSRHRSGVELDWVRHHYTEGERGWGREKFYPDRPRWDRCRYYHDRYALYAARDWKPFHGGREHERAGLHERPHKDHNRGRRGCEPARERERHRPSSPRAGAPHALAPHPDRFSHDRTALVAGDNCNLSDRFHEHENGKSRKRRHDSVENSDSHVEKKARRSEQKDPLEEPKAKKHKKSKKKKKSKDKHRDRDSRHQQDSDLSAACSDADLHPRAEFAVVLPF

SEQ ID NO: 896754 - protein, 1020 aa, Homo sapiens [sequence omitted]

SEQ ID NO: 896755 - protein, 236 aa, Homo sapiens
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNKLDKTHPNLYDPNGSSGQ

SEQ ID NO: 896756 - protein, 1316 aa, Homo sapiens
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLHSNSLENPTKPVPSSTITNSAVQSTSNASTMSVSSKVTKPIPRSESCSQPVMNGKSKLNSSVLVPYGAESSEDSDEESKGLGKENGIGTIVSSHSPGQDAEDEEATPHELQEPMTLNGANSADSDSDPKENGLAPDGASCQGQPALHSENPFAKANGLPGKLMPAPLLSLPEDKILETFRLSNKLKGSTDEMSAPGAERGPPEDRDAEPQPGSPAAESLEEPDAAAGLSSTKKAPPPRDPGTPATKEGAWEAMAVAPEEPPPSAGEDIVGDTAPPDLCDPGSLTGDASPLSQDAKGMIAEGPRDSALAEAPEGLSPAPPARSEEPCEQPLLVHPSGDHARDAQDPSQSLGAPEAAERPPAPVLDMAPAGHPEGDAEPSPGERVEDAAAPKAPGPSPAKEKIGSLRKVDRGHYRSRRERSSSGEPARESRSKTEGHRHRRRRTCPRERDRQDRHAPEHHPGHGDRLSPGERRSLGRCSHHHSRHRSGVELDWVRHHYTEGERGWGREKFYPDRPRWDRCRYYHDRYALYAARDWKPFHGGREHERAGLHERPHKDHNRGRRGCEPARERERHRPSSPRAGAPHALAPHPDRFSHDRTALVAGDNCNLSDRFHEHENGKSRKRRHDSVENSDSHVEKKARRSEQKDPLEEPKAKKHKKSKKKKKSKDKHRDRDSRHQQDSDLSAACSDADLHRHKKKKKKKKRHSRKSEDFVKDSELHLPRVTSLETVAQFRRAQGGFPLSGGPPLEGVGPFREKTKHLRMESRDDRCRLFEYGQGD

SEQ ID NO: 896757 - protein, 1209 aa, Homo sapiens
KDFMLTGHTMQGHVVRKQKTGARGRHYWPEPSLRFPWEKQGHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKITISIHNKLPVRQCQSQPNLHSNSLENPTKPVPSSTITNSAVQSTSNASTMSVSSKVTKPIPRSESCSQPVMNGKSKLNSSVLVPYGAESSEDSDEESKGLGKENGIGTIVSSHSPGQDAEDEEATPHELQEPMTLNGANSADSDSDPKENGLAPDGASCQGQPALHSENPFAKANGLPGKLMPAPLLSLPEDKILETFRLSNKLKGSTDEMSAPGAERGPPEDRDAEPQPGSPAAESLEEPDAAAGLSSTKKAPPPRDPGTPATKEGAWEAMAVAPEEPPPSAGEDIVGDTAPPDLCDPGSLTGDASPLSQDAKGMIAEGPRDSALAEAPEGLSPAPPARSEEPCEQPLLVHPSGDHARDAQDPSQSLGAPEAAERPPAPVLDMAPAGHPEGDAEPSPGERVEDAAAPKAPGPSPAKEKIGSLRKVDRGHYRSRRERSSSGEPARESRSKTEGHRHRRRRTCPRERDRQDRHAPEHHPGHGDRLSPGERRSLGRCSHHHSRHRSGVELDWVRHHYTEGERGWGREKFYPDRPRWDRCRYYHDRYALYAARDWKPFHGGREHERAGLHERPHKDHNRGRRGCEPARERERHRPSSPRAGAPHALAPHPDRFSHDRTALVAGDNCNLSDRFHEHENGKSRKRRHDSVENSDSHVEKKARRSEQKDPLEEPKAKKHKKSKKKKKSKDKHRDRDSRHQQDSDLSAACSDADLHRHKKKKKKKKRHSRKSEDFVKDSELHLPRVTSLETVAQFRRAQGGFPLSGGPPLEGVGPFREKTKHLRMESRDDRCRLFEYGQGD

SEQ ID NO: 896758 - protein, 550 aa, Homo sapiens
MTIVDKASESSDPSAYQNQPGSSEAVSPGDMDAGSASWGAVSSLNDVSNHTLSLGPVPGAVVYSSSSVPDKSKPSPQKDQALGDGIAPPQKVLFPSEKICLKWQQTHRVGAGLQNLGNTCFANAALQCLTYTPPLANYMLSHEHSKTCHAEGFCMMCTMQAHITQALSNPGDVIKPMFVINEMRRIARHFRFGNQEDAHEFLQYTVDAMQKACLNGSNKLDRHTQATTLVCQIFGGYLRSRVKCLNCKGVSDTFDPYLDITLEIKAAQSVNKALEQFVKPEQLDGENSYKCSKCKKMVPASKRFTIHRSSNVLTLSLKRFANFTGGKIAKDVKYPEYLDIRPYMSQPNGEPIVYVLYAVLVHTGFNCHAGHYFCYIKASNGLWYQMNDSIVSTSDIRSVLSQQAYVLFYIRSHDVKNGGELTHPTHSPGQSSPRPVISQRVVTNKQAAPGFIGPQLPSHMIKNPPHLNGTGPLKDTPSSSMSSPNGNSSVNRASPVNASASVQNWSVNRSSVIPEHPKKQKIKEEKEIQRQTPRPRLQASAGLRPLSSVL

SEQ ID NO: 896759 - protein, 102 aa, Homo sapiens
LPGESCRGLVGALTPGPAMPTPLLPLLLRLLLSCLLLPAARLARQYLLPLLRRLARRLGSQDMREALLGCLLFILSQRHSPDAGEASRVDRLERRERLGPQK

SEQ ID NO: 896760 - protein, 1976 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896761 - protein, 309 aa, Homo sapiens
MTATYETPALTSRTRVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEGYRIIPGGTYNQGQNGFDLVFQGPSNAVYLLEVKHVSTASGGRFSNVNMARVIPQKKKMIRVEL

SEQ ID NO: 896762 - protein, 163 aa, Homo sapiens
LPFTTKKTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQVGRPRVVSSWQSSCFCSFGL

SEQ ID NO: 896763 - protein, 1976 aa, Homo sapiens; identical to SEQ ID NO: 896760

SEQ ID NO: 896764 - protein, 1986 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPQESPKPVKHQGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896765 - protein, 2010 aa, Homo sapiens
LRANPSDNQSHNLWSPLKFTLETRGNCFWIVPFTMAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896766 - protein, 1781 aa, Homo sapiens
QESPKPVKHQSGSLLYGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896767 - protein, 1749 aa, Homo sapiens
MYLLIFNFLFLIYFQGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896768 - protein, 1252 aa, Homo sapiens
MTEYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896769 - protein, 1690 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896770 - protein, 1976 aa, Homo sapiens; identical to SEQ ID NO: 896760

SEQ ID NO: 896771 - protein, 1849 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQAALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896772 - protein, 1153 aa, Homo sapiens
MFLLTGEVLPLIHPDERMICASPEKWIVEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896773 - protein, 965 aa, Homo sapiens
RRKMSPAKENKTETWLRKRRSERYEEGQRQTYIDRVIDRKTGRKRNRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896774 - protein, 797 aa, Homo sapiens
GLAVPRLLVSRLYLVPRLYLVSRLYLVSRLYLDLQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896775 - protein, 664 aa, Homo sapiens
LPFTTKKTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896776 - protein, 1976 aa, Homo sapiens; identical to SEQ ID NO: 896760

SEQ ID NO: 896777 - protein, 1976 aa, Homo sapiens; identical to SEQ ID NO: 896760

SEQ ID NO: 896778 - protein, 1976 aa, Homo sapiens; identical to SEQ ID NO: 896760

SEQ ID NO: 896779 - protein, 1976 aa, Homo sapiens; identical to SEQ ID NO: 896760

SEQ ID NO: 896780 - protein, 300 aa, Homo sapiens
RVWKQKSVQVDRVGNVGARVWRLSRRASTAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 896781 - protein, 1976 aa, Homo sapiens; identical to SEQ ID NO: 896760

SEQ ID NO: 896782 - protein, 2003 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLSMDHVDFQMVSRTAWLCRRPPHVRSKQPWTPKPSWWKAPPRRQPGPHADLANSAAALSPKWEYWFCVRGLFQVCQ

SEQ ID NO: 896783 - protein, 1976 aa, Homo sapiens; identical to SEQ ID NO: 896760

SEQ ID NO: 896784 - protein, 1931 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRLR

SEQ ID NO: 896785 - protein, 1699 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESLRRTSSTETLCQPQTFLIHLT

SEQ ID NO: 896786 - protein, 916 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEGYRIIPGGTYNQGQNGFDLVFQGPSNAVYLLEVKHVSTASGGRFSNVNMARVIPQKKKMIRVELI

SEQ ID NO: 896787 - protein, 840 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARNDYAKKQQHVSDQKFYHKAYGGALNFLHWQWWSDSSK

SEQ ID NO: 896788 - protein, 750 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEIYSNAILRFMDGTGLLTDDRA

SEQ ID NO: 896789 - protein, 625 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVHIL

SEQ ID NO: 896790 - protein, 101 aa, Homo sapiens
YSGLFCVVINPYKNLPIYSENIIEMYRGKKRHEMPPHIYAISESAYRCMLQGNWKYLNTKCSEFLKCNLLFFNVSMYSTKVKFYFFKINKKVMFIVEKLSF

SEQ ID NO: 896791 - protein, 113 aa, Homo sapiens
VRHEFFNTGVFVLVINVMEVLPFTTKKTQELLQEETRQKLNLSSRIRQLEEEKNSLQEQQEEEEEARKNLEKQVLALQSQVCVLFRRPRWPRCVPSADPGPAVLGCLSSIWDS

SEQ ID NO: 896792 - protein, 210 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPWAPGHRRAALLRPLGLRQPPGQAVGWPG

SEQ ID NO: 896793 - protein, 216 aa, Homo sapiens
YGYRRPTRPGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPWAPGHRRAALLRPLGLRQPPGQAVGWPG

SEQ ID NO: 896794 - protein, 217 aa, Homo sapiens
KITARYEAWVGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPWAPGHRRAALLRPLGLRQPPGQAVGWPG

SEQ ID NO: 896795 - protein, 210 aa, Homo sapiens; identical to SEQ ID NO: 896792

SEQ ID NO: 896796 - protein, 74 aa, Homo sapiens
AAARHDRRVKYQAPDIDVQLSSELTDSLRTLNARGQHPSRPVQELPEEEYDRASRESQVQTQVQGEAGGEAGVP

SEQ ID NO: 896797 - protein, 202 aa, Homo sapiens
QESTFQGGLLRGGQGATQESTFQELCEGLLEESDGEGEPGQGEGPEAGDAEVCPTPARLATTEKKTEQQRRREKAVHRLRVQQAALRAARLRHQELFRLRGIKAQVALRLAELARRRRRRQARREAEADKPRRLGRLKYQAPDIDVQLSSELTDSLRTLNARGQHPSRPVQELPEEEYDRASRESQVQTQVQGEAGGEAGVP

SEQ ID NO: 896798 - protein, 206 aa, Homo sapiens
PRLVLQGVVCGPEVVEGPLYGVLGPGLGPCCRRVEEPDGEGEPGQGEGPEAGDAEVCPTPARLATTEKKTEQQRRREKAVHRLRVQQAALRAARLRHQELFRLRGIKAQVALRLAELARRRRRRQARREAEADKPRRLGRLKYQAPDIDVQLSSELTDSLRTLNARGQHPSRPVQELPEEEYDRASRESQVQTQVQGEAGGEAGVP

SEQ ID NO: 896799 - protein, 92 aa, Homo sapiens
FGTMAGRHPGGREAGGRLGDNPKLGRLKYQAPDIDVQLSSELTDSLRTLNARGQHPSRPVQELPEEEYDRASRESQVQTQVQGEAGGEAGVP

SEQ ID NO: 896800 - protein, 210 aa, Homo sapiens; identical to SEQ ID NO: 896792

SEQ ID NO: 896801 - protein, 217 aa, Homo sapiens; identical to SEQ ID NO: 896794

SEQ ID NO: 896802 - protein, 210 aa, Homo sapiens; identical to SEQ ID NO: 896792

SEQ ID NO: 896803 - protein, 210 aa, Homo sapiens; identical to SEQ ID NO: 896792

SEQ ID NO: 896804 - protein, 210 aa, Homo sapiens; identical to SEQ ID NO: 896792

SEQ ID NO: 896805 - protein, 210 aa, Homo sapiens; identical to SEQ ID NO: 896792

SEQ ID NO: 896806 - protein, 132 aa, Homo sapiens
MPRSVPRPPAWPPQRRRRSSSGGGRRLCTGCGYSRPRCGPPGSGTRSCSGCARREAEADKPRRLGRLKYQAPDIDVQLSSELTDSLRTLNARGQHPSRPVQELPEEEYDRASRESQVQTQVQGEAGGEAGVP

SEQ ID NO: 896807 - protein, 210 aa, Homo sapiens; identical to SEQ ID NO: 896792

SEQ ID NO: 896808 - protein, 210 aa, Homo sapiens; identical to SEQ ID NO: 896792

SEQ ID NO: 896809 - protein, 210 aa, Homo sapiens; identical to SEQ ID NO: 896792

SEQ ID NO: 896810 - protein, 210 aa, Homo sapiens; identical to SEQ ID NO: 896792

SEQ ID NO: 896811 - protein, 210 aa, Homo sapiens; identical to SEQ ID NO: 896792

SEQ ID NO: 896812 - protein, 210 aa, Homo sapiens; identical to SEQ ID NO: 896792

SEQ ID NO: 896813 - protein, 210 aa, Homo sapiens; identical to SEQ ID NO: 896792

SEQ ID NO: 896814 - protein, 210 aa, Homo sapiens; identical to SEQ ID NO: 896792

SEQ ID NO: 896815 - protein, 210 aa, Homo sapiens; identical to SEQ ID NO: 896792

SEQ ID NO: 896816 - protein, 210 aa, Homo sapiens; identical to SEQ ID NO: 896792

SEQ ID NO: 896817 - protein, 210 aa, Homo sapiens; identical to SEQ ID NO: 896792

SEQ ID NO: 896818 - protein, 210 aa, Homo sapiens; identical to SEQ ID NO: 896792

SEQ ID NO: 896819 - protein, 200 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPWAPGHRRAALLRPLGLRQ

SEQ ID NO: 896820 - protein, 323 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVPCPARLHTKPSQAPAVEVAPAGASYNPSFEDHQTLLSAAHEVEVAAAERRRRSWSGSWPCPPRSRPPPRSPHSRSCARGCWRSRMVRGSQARARGRRLGMPRSVPRPPAWPPQRRRRSSSGGGRRLCTGCGYSRPRCGPPGSGTRSCSGCAGSRPRWP

SEQ ID NO: 896821 - protein, 210 aa, Homo sapiens; identical to SEQ ID NO: 896792

SEQ ID NO: 896822 - protein, 210 aa, Homo sapiens; identical to SEQ ID NO: 896792

SEQ ID NO: 896823 - protein, 210 aa, Homo sapiens; identical to SEQ ID NO: 896792

SEQ ID NO: 896824 - protein, 251 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPWAPGHRRAALLRPLGLRQPHGLHDFFQKKNKKKKKKKGGEDIREYCHNKGCHQYWQLYPVFFATRVGPP

SEQ ID NO: 896825 - protein, 234 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKESTFQELCEGLLEESDGEGEPGQGEGPEAGDAEVCPTPARLATTEKKTEQQRRREKAVHRLRVQQAALRAARLRHQELFRLRAAGG

SEQ ID NO: 896826 - protein, 117 aa, Homo sapiens
MAAGGSGVGGKRSSKSDADSGFLGLRPTSVDPALRRRRREAEADKPRRLGRLKYQAPDIDVQLSSELTDSLRTLNARGQHPSRPVQELPEEEYDRASRESQVQTQVQGEAGGEAGVP

SEQ ID NO: 896827 - protein, 106 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGTRHLTSTCS

SEQ ID NO: 896828 - protein, 139 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKEVSVPAS

SEQ ID NO: 896829 - protein, 117 aa, Homo sapiens; identical to SEQ ID NO: 896826

SEQ ID NO: 896830 - protein, 201 aa, Homo sapiens
AAARGGGGGGAGSSRAAASRPRAGAGASGAEPRSGRERSRLSGRRAPAMARNTLSSRFRRVDIDEFDENKFVDEQEEAAAAAAEPGPDPSEVDGLLRQGDMLRAFHAALRNSPVNTKNQAVKERAQGVVLKVLTNFKSSEIEQAVQSLDRNGVDLLMKYIYKGFEKPTENSSAVLLQWHEKALAVGGLGSIIRVLTARKTV

SEQ ID NO: 896831 - protein, 201 aa, Homo sapiens; identical to SEQ ID NO: 896830

SEQ ID NO: 896832 - protein, 201 aa, Homo sapiens; identical to SEQ ID NO: 896830

SEQ ID NO: 896833 - protein, 121 aa, Homo sapiens
MTAWMCLSLAILNWWCCTGDMLRAFHAALRNSPVNTKNQAVKERAQGVVLKVLTNFKSSEIEQAVQSLDRNGVDLLMKYIYKGFEKPTENSSAVLLQWHEKALAVGGLGSIIRVLTARKTV

SEQ ID NO: 896834 - protein, 201 aa, Homo sapiens; identical to SEQ ID NO: 896830

SEQ ID NO: 896835 - protein, 201 aa, Homo sapiens; identical to SEQ ID NO: 896830

SEQ ID NO: 896836 - protein, 559 aa, Homo sapiens
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 896837 - protein, 559 aa, Homo sapiens; identical to SEQ ID NO: 896836

SEQ ID NO: 896838 - protein, 559 aa, Homo sapiens; identical to SEQ ID NO: 896836

SEQ ID NO: 896839 - protein, 549 aa, Homo sapiens
ILHSQSIGITDMSHCTCQLPNSLPFFKRRFRFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 896840 - protein, 314 aa, Homo sapiens
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSSMKKEMLCVLLTVVALDSRTVPGLRSLRIIC

SEQ ID NO: 896841 - protein, 597 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 896842 - protein, 127 aa, Homo sapiens
MEASQSEFCGFSSKNNKNGRRRNLRGSRTAAGPCWTVPVHVPGHGAGEPAHHPAMSPDSHLHTSMYFFLSNLSLPDIGFTSTTVPQMTVDIQSRSRVISYAGCLTQKSLFAIFGGTEERHAPECDGL

SEQ ID NO: 896843 - protein, 127 aa, Homo sapiens; identical to SEQ ID NO: 896842

SEQ ID NO: 896844 - protein, 597 aa, Homo sapiens; identical to SEQ ID NO: 896841

SEQ ID NO: 896845 - protein, 597 aa, Homo sapiens; identical to SEQ ID NO: 896841

SEQ ID NO: 896846 - protein, 597 aa, Homo sapiens; identical to SEQ ID NO: 896841

SEQ ID NO: 896847 - protein, 597 aa, Homo sapiens; identical to SEQ ID NO: 896841

SEQ ID NO: 896848 - protein, 574 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKKYKPGRCDDILKWKPPSLNSVDFRLKITRMGGEGLLPQNVGLLYVGGYERPFAQIKVTKELKQYDNKIIECKFENNSWVFMRQRTDKSFPNAYNTAMAVCNSISNPVTKEMLFEFIDRCTAASQGQKRKHHLDPDTELMPPPPPKRPRPLT

SEQ ID NO: 896849 - protein, 597 aa, Homo sapiens; identical to SEQ ID NO: 896841

SEQ ID NO: 896850 - protein, 541 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGLLPQNVGLLYVGGYERPFAQIKVCLFIFSVLFLDVLLSRIHQNLANNNQHIKISCSSTLGG

SEQ ID NO: 896851 - protein, 512 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGKYKPGRCDDILKWKPPSLNSVDFRLKITRMGGEGTSEDPERQLVLAGLFLSMCLVMVLGNLLIIRP

SEQ ID NO: 896852 - protein, 457 aa, Homo sapiens
MAHNKIPPRWLNCPRRGQPVAGRFLPLKTMLGPRYDSQVAEENRFHPSMLSNYLKSLKVKMGLLVDLTNTSRFYDRNDIEKEGIKYIKLQCKGHGECPTTENTETFIRLCERFNERNPPELIGVHCTHGFNRTGFLICAFLVEKMDWSIEAAVATFAQARPPGIYKGDYLKELFRRYGDIEEAPPPPLLPDWCFEDDEDEDEDEDGKKESEPGSSASFGKRRKERLKLGAIFLEGVTVKGVTQVTTQPKLGEVQQKCHQFCGWEGSGFPGAQPVSMDKQNIKLLDLKPYKVSWKADGTRYMMLIDGTNEVFMIDRDNSVFHVSNLEFPFRKDLRMHLSNTLLDGEMIIDRVNGQAVPRYLIYDIIKFNSQPVGDCDFNVRLQCIEREIISPRHEKMKTGLIDKTQEPFSVRNKPFFDICTSRKLLEGNFAKEVSHEMDGLIFQPTGIRGFALLPRLV

SEQ ID NO: 896853 - protein, 115 aa, Homo sapiens
MFQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPGNHADTWPH

SEQ ID NO: 896854 - protein, 1227 aa, Homo sapiens
HILCKNGITNDFSMIPVMFRDNTLRLLFTYLKCSMSYIVRSSILEMRAVRLASLALGRRRHDWSMPGGWRDLSPSSALAVCSPISHGDLFLTCLLSDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 896855 - protein, 772 aa, Homo sapiens [sequence omitted]

SEQ ID NO: 896856 - protein, 1605 aa, Homo sapiens
QAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPLSAACTIAVSLAGMST

SEQ ID NO: 896857 - protein, 1103 aa, Homo sapiens
QAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQ

SEQ ID NO: 896858 - protein, 150 aa, Homo sapiens
HILCKNGITNDFSMIPVMFRDNTLRLLFTYLKCSMSYIVRSSILEMRAVRLASLALGRRRHDWSMPGGWRDLSPSSALSCLFSHLPWRPVPDLSSFRCGRRECPGMAAGSVLRTERDLSEPLESSSVLCFSSSSPLPLAGACGTSSWAFS

SEQ ID NO: 896859 - protein, 2022 aa, Homo sapiens
QAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 896860 - protein, 1983 aa, Homo sapiens
QAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAVASCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 896861 - protein, 2003 aa, Homo sapiens
QAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENL

SEQ ID NO: 896862 - protein, 434 aa, Homo sapiens
QAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGSGHYLPNSRLLLSPKPCYSCAPGSCTPQKFPSRCHLRIKHWWRCQLLLEENPSGLGIGRFPERAETH

SEQ ID NO: 896863 - protein, 133 aa, Homo sapiens
KGPMPSTSFSNPSVCSPGFPGWSSESISRGLGGKRTQHAWQSVSGVGRAMEEAVDMAASSGLSVVALPRPQASSGPEAEEEEEDDEDDVPEWQQDEFDEELDNDSFSYDESENLDQETFFFGDEEEDEDEAYD

SEQ ID NO: 896864 - protein, 70 aa, Homo sapiens
VELLTNQVGEKMVVVQALRLLYLLMTKHEWRPLFAREGGIYAVLVCMQEYKTSVLVQQAGLAVSTLGLAG

SEQ ID NO: 896865 - protein, 385 aa, Homo sapiens
ADRIGGPAPSPSMGVVAATAGSASRSLRPQRTSHRLSVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKSSLKKRFWKTRTCFSPVKPQIMADSSMMTISIMMSFNL

SEQ ID NO: 896866 - protein, 385 aa, Homo sapiens; identical to SEQ ID NO: 896865

SEQ ID NO: 896867 - protein, 425 aa, Homo sapiens
ADRIGGPAPSPSMGVVAATAGSASRSLRPQRTSHRLSVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKSSLKKRFWKTRTCFSPVKPQIMADSSMMTISIMMSFNPRLVQKKGPFKFGPPPFGANSRGLSPQFTRDFWRKLGLEHN

SEQ ID NO: 896868 - protein, 403 aa, Homo sapiens
ADRIGGPAPSPSMGVVAATAGSASRSLRPQRTSHRLSVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKEFAICKKQSFCFWLLRFNLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKSSLKKRFWKTRTCFSPVKPQIMADSSMMTISIMMSFNL

SEQ ID NO: 896869 - protein, 230 aa, Homo sapiens
ADRIGGPAPSPSMGVVAATAGSASRSLRPQRTSHRLSVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKHQCGGLGLHPQSQSA

SEQ ID NO: 896870 - protein, 292 aa, Homo sapiens
ADRIGGPAPSPSMGVVAATAGSASRSLRPQRTSHRLSVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPSKSPGRM

SEQ ID NO: 896871 - protein, 451 aa, Homo sapiens
ADRIGGPAPSPSMGVVAATAGSASRSLRPQRTSHRLSVAARGASQPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKVLMHMGKFSPLLVKRKAATLSSLYVVLALRFITLPLYRMDGRKQNLIKAKPGFRSRLDAALKNVIRFVSILKNVAMYMTVTLVIQEGFQEDTMTKMVHGICLPFGTKFLAVIHRVRIPTAHNEKPANEDPEWILVEKDRFVNDYDKDNDGRLDPQELLPWVVPNNQGIAQEEEALSSKLNATWDLKLVDKTYASTDTQRAFWEQTPELVYFHPVERPTRIYCAQNTLHCMTTFPNP

SEQ ID NO: 896872 - protein, 385 aa, Homo sapiens; identical to SEQ ID NO: 896865

SEQ ID NO: 896873 - protein, 385 aa, Homo sapiens; identical to SEQ ID NO: 896865

SEQ ID NO: 896874 - protein, 292 aa, Homo sapiens; identical to SEQ ID NO: 896870

SEQ ID NO: 896875 - protein, 134 aa, Homo sapiens
MTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKSSLKKRFWKTRTCFSPVKPQIMADSSMMTISIMMSFNL

SEQ ID NO: 896876 - protein, 255 aa, Homo sapiens
LSCIPIAPSHPLPTMVGASSVRMARCGAGWPARRRGGAPGARVLGPRFGSLRHAGPLRYRGETHGPERIGYPQLSQTLQKLVFDPQAYRTISAGASPPAPNSLGLTTKLFPHMPSRLRKTRKLRGHVSHGHGRIGKHRKHPGGRGNAGGLHHHRINFDKYHPGYFGKVGMKHYHLKRNQSFCPTVNLDKLWTLVSEQTRVNAAKNKTGAAPIIDVVRSGYYKVLGKGKLPKQAVTVQAKFFSRRAEEKIKSVGGA

SEQ ID NO: 896877 - protein, 143 aa, Homo sapiens
MPSRLRKTRKLRGHVSHGHGRIGKHRKHPGGRGNAGGLHHHRINFDKYHPGYFGKVGMKHYHLKRNQSFCPTVNLDKLWTLVSEQTRVNAAKNKTGAAPIIDVVRSGYYKVLGKGKLPKQAVTVQAKFFSRRAEEKIKSVGGA

SEQ ID NO: 896878 - protein, 140 aa, Homo sapiens
DISGYIGKVGMKHYHLKRNQSFCPTVNLDKIVDLVGEQTRATSTDHSGYFGKVGMKHYHLKRNQSFCPTVNLDKLWTLVSEQTRVNAAKNKTGAAPIIDVVRSGYYKVLGKGKLPKQAVTVQAKFFSRRAEEKIKSVGGA

SEQ ID NO: 896879 - protein, 697 aa, Homo sapiens
GALSWLGPGKASLLRSFPHLCTLLPDFRLQDPQRAPAFHLSSETLPFSRKSTQETRKMATGLLRAKKEAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896880 - protein, 83 aa, Homo sapiens
QAGSADGVRVYSGQCDSAVLGCSAKRPPDVGRWRVSSVESWPSASAAGKSAIATAGTRTGCVPALPHPSTGLVGARTDCDVVS

SEQ ID NO: 896881 - protein, 645 aa, Homo sapiens
MVHRQTMSCSGAGGITAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896882 - protein, 645 aa, Homo sapiens; identical to SEQ ID NO: 896881

SEQ ID NO: 896883 - protein, 598 aa, Homo sapiens
MLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896884 - protein, 687 aa, Homo sapiens
MGIGCSGDFCDIPDPNCGALERTALHFVGRVFPPRPLLFLFTSPDLSSETLPFSRKSTQETRKMATGLLRAKKEKFHLLNQNSLLSWSEGKRPGERRENVHWTSVQGEWFQLSPIQYEVGCRSVTDNSSYFDESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896885 - protein, 581 aa, Homo sapiens [sequence omitted]

SEQ ID NO: 896886 - protein, 312 aa, Homo sapiens
MRCDFWLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896887 - protein, 598 aa, Homo sapiens; identical to SEQ ID NO: 896883

SEQ ID NO: 896888 - protein, 228 aa, Homo sapiens
GALSWLGPGKASLLRSFPHLCTLLPDFRLQDPQRAPAFHLSSETLPFSRKSTQETRKMATGLLRAKKEAFVAFRDVAVYFTQEEWRLLSPAQRTLHREVMLETYNHLVSLEIPSSKPKLIAQLERGEAPWREERKCPLDLCPDGALLCCQAGIQWCYIGSLQPLPPGFKQFPCLSLLSSWDYRCTPPHLANFLYFSRDGVSPCWPGWSQSPDLVIHPPQPPKVLGLQA

SEQ ID NO: 896889 - protein, 598 aa, Homo sapiens; identical to SEQ ID NO: 896883

SEQ ID NO: 896890 - protein, 598 aa, Homo sapiens; identical to SEQ ID NO: 896883

SEQ ID NO: 896891 - protein, 386 aa, Homo sapiens
MYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896892 - protein, 386 aa, Homo sapiens; identical to SEQ ID NO: 896891

SEQ ID NO: 896893 - protein, 595 aa, Homo sapiens
MKSHSVAQAGVQWRDLGSLQPPPPGFKQFSASASRLAGTTESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 896894 - protein, 286 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKLLCSWYVYLLDPENGEANHKPHLTANCSVPSAQARSQMS

SEQ ID NO: 896895 - protein, 289 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKVCGFRCSGVSFILSA

SEQ ID NO: 896896 - protein, 259 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKIQRMEKPIINHT

SEQ ID NO: 896897 - protein, 259 aa, Homo sapiens; identical to SEQ ID NO: 896896

SEQ ID NO: 896898 - protein, 252 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEVAVSRDGAIALFGQQE

SEQ ID NO: 896899 - protein, 312 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKKIGKV

SEQ ID NO: 896900 - protein, 257 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKMAAQRQKRGK

SEQ ID NO: 896901 - protein, 286 aa, Homo sapiens; identical to SEQ ID NO: 896894

SEQ ID NO: 896902 - protein, 256 aa, Homo sapiens
MKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKLLCSWYVYLLDPENGEANHKPHLTANCSVPSAQARSQMS

SEQ ID NO: 896903 - protein, 277 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896904 - protein, 277 aa, Homo sapiens; identical to SEQ ID NO: 896903

SEQ ID NO: 896905 - protein, 277 aa, Homo sapiens; identical to SEQ ID NO: 896903

SEQ ID NO: 896906 - protein, 242 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896907 - protein, 277 aa, Homo sapiens; identical to SEQ ID NO: 896903

SEQ ID NO: 896908 - protein, 277 aa, Homo sapiens; identical to SEQ ID NO: 896903

SEQ ID NO: 896909 - protein, 277 aa, Homo sapiens; identical to SEQ ID NO: 896903

SEQ ID NO: 896910 - protein, 228 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATFVGITYALTVVWLLVFACSAVPVYIYFNTWTTCQSIAFPSKTSASIGSLCADARMYGVLPWNAFPGKVCGSNLLSICKTAEAAATLVSLLTFMIAATYNFAVLKLMGRGTKF

SEQ ID NO: 896911 - protein, 368 aa, Homo sapiens
MTPGFHWHPVQAAGCHQEGWQCLLRNPLAVQEPSWTQEYFAKGTQQNQWKQNHRNRRRGQRYSERKSKRPKKEAGETRILPAEQSQPQSRLASRLQLESESQRHGLVRVLCKMSGRGPLCFPGGHCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896912 - protein, 259 aa, Homo sapiens
MGLLECCARCLVGAPFASLVATGLCFFGVALFCGCGHEALTGTEKLIETYFSIIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896913 - protein, 320 aa, Homo sapiens
MTPGFHWHPVQAAGCHQEGWQCPLEESLGSARSLAGLKNILPRAPSRTNGSRITEIGEEDKDTQREKVKDRRRRLESCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896914 - protein, 224 aa, Homo sapiens
MGLLECCARCLVGAPFASLVATGLCFFGVALFCGCGHEALTGTEKLIETYFSIIYGTASFFFLYGALLLAEGFYTTGAVRQIFGDYKTTICGKGLSATFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896915 - protein, 183 aa, Homo sapiens
LVMLEVMFLVNRRGKICRVPFTFSRAEFGTRFNSQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 896916 - protein, 245 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEAHFMGYYPFSHRR

SEQ ID NO: 896917 - protein, 277 aa, Homo sapiens; identical to SEQ ID NO: 896903

SEQ ID NO: 896918 - protein, 160 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKVIILRILWQ

SEQ ID NO: 896919 - protein, 277 aa, Homo sapiens; identical to SEQ ID NO: 896903

SEQ ID NO: 896920 - protein, 277 aa, Homo sapiens; identical to SEQ ID NO: 896903

SEQ ID NO: 896921 - protein, 277 aa, Homo sapiens; identical to SEQ ID NO: 896903

SEQ ID NO: 896922 - protein, 312 aa, Homo sapiens
ETQPKACREQNMEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 896923 - protein, 104 aa, Homo sapiens [sequence omitted]

SEQ ID NO: 896924 - protein, 104 aa, Homo sapiens [sequence omitted]

SEQ ID NO: 896925 - protein, 104 aa, Homo sapiens [sequence omitted]

SEQ ID NO: 896926 - protein, 243 aa, Homo sapiens [sequence omitted]

SEQ ID NO: 896927 - protein, 293 aa, Homo sapiens
ETQPKACREQNMEGDFSVCRNCKRHVVSANFTLHEAYCLRFLVLCPECEEPVPKETMEEHCKLEHQQANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 896928 - protein, 143 aa, Homo sapiens
MIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 896929 - protein, 121 aa, Homo sapiens
ETQPKACREQNMEGDFSVCRNCKRHVVSANFTLHEAYCLRFLVLCPECEEPVPKETMEEHCKLEHQQAYGSGIGKRFWFQERLAVLLRSVKRGCESIPPGAPDLSLWRYSSSGSRCQLRLV

SEQ ID NO: 896930 - protein, 918 aa, Homo sapiens
LGRSRSRHPPGARVLLALPGIPMAAAGPRRSVRGAVCLHLLLTLVIFSRDGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 896931 - protein, 856 aa, Homo sapiens
LGRSRSRHPPGARVLLALPGIPMAAAGPRRSVRGAVCLHLLLTLVIFSRDGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEESI

SEQ ID NO: 896932 - protein, 918 aa, Homo sapiens; identical to SEQ ID NO: 896930

SEQ ID NO: 896933 - protein, 918 aa, Homo sapiens; identical to SEQ ID NO: 896930

SEQ ID NO: 896934 - protein, 145 aa, Homo sapiens
MTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 896935 - protein, 90 aa, Homo sapiens
KVEGTKSKGALAPRRELRYDVGCMSKLHRCNQNEDRMPSQDYVLTYNYEGRGSPAGSVGCCSEKQEEDGLDFLNNLEPKFITLAEACTKR

SEQ ID NO: 896936 - protein, 77 aa, Homo sapiens
RMRLMNPGAVFKAVYGRFRRIWVGVKATSSASYFFLGLALPFPFSGQWQLPFESGEGSANLFSMAHLIWSEKSRRQS

SEQ ID NO: 896937 - protein, 270 aa, Homo sapiens
QHKRLDYEQCKVLASRSGEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 896938 - protein, 145 aa, Homo sapiens; identical to SEQ ID NO: 896934

SEQ ID NO: 896939 - protein, 145 aa, Homo sapiens; identical to SEQ ID NO: 896934

SEQ ID NO: 896940 - protein, 145 aa, Homo sapiens; identical to SEQ ID NO: 896934

SEQ ID NO: 896941 - protein, 295 aa, Homo sapiens
RLRDPWEPRCIVGERKMAAPVRRTLLGVAGGWRRFERLWAGSLSSRSLALAAAPSSNGSPWRLLGALCLQRPPVVSKPLTPLQEEMASLLQQIEIERSLYSDHELRALDENQRLAKKKADLHDEEDEQDILLAQDLEDMWEQKFLQFKLGARITEADEKNDRTSLNRKLDRNLVLLVREKFGDQDVWILPQAEWQPGETLRGTAERTLATLSENNMEAKFLGNAPCGHYTFKFPQAMRTESNLGAKVFFFKALLLTGDFSQAGNKGHHVWVTKDELGDYLKPKYLAQVRRFVSDL

SEQ ID NO: 896942 - protein, 217 aa, Homo sapiens
ALEDLGVPLSLLQQIEIERSLYSDHELRALDENQRLAKKKADLHDEEDEQDILLAQDLEDMWEQKFLQFKLGARITEADEKNDRTSLNRKLDRNLVLLVREKFGDQDVWILPQAEWQPGETLRGTAERTLATLSENNMEAKFLGNAPCGHYTFKFPQAMRTESNLGAKVFFFKALLLTGDFSQAGNKGHHVWVTKDELGDYLKPKYLAQVRRFVSDL

SEQ ID NO: 896943 - protein, 222 aa, Homo sapiens
ALEDLGVPLSLLQQIEIERSLYSDHELRALDENQRLAKKKADLHDEEDEQDILLAQDLEDMWEQKFLQFKLGARITEADEKNDRTSLNRKLDRNLVLLVREKFGDQDVWILPQAEWQPGETLRGTAERTLATLSENNMEAKFLGNAPCGHYTFKFPQAMRTESNLGAKVFFFKALLLTGDFSQAGTKGNTGVSLCLLPFTKSVALPPKFLSPLPLLRRLPLS

SEQ ID NO: 896944 - protein, 295 aa, Homo sapiens; identical to SEQ ID NO: 896941

SEQ ID NO: 896945 - protein, 295 aa, Homo sapiens; identical to SEQ ID NO: 896941

SEQ ID NO: 896946 - protein, 185 aa, Homo sapiens
RLRDPWEPRCIVGERKMAAPVRRTLLGVAGGWRRFERLWAGSLSSRSLALAAAPSSNGSPWRLLGALCLQRPPVVSKPLTPLQEEMASLLQQIEIERSLYSDHELRALDENQRLAKKKADLHDEEDEQDILLAQDLEDMWEQKFLQFKLGARITGCDPFRPARRKGKGVFGFPNKRQLLGPCFVF

SEQ ID NO: 896947 - protein, 167 aa, Homo sapiens
RLRDPWEPRCIVGERKMAAPVRRTLLGVAGGWRRFERLWAGSLSSRSLALAAAPSSNGSPWRLLGALCLQRPPVVSKPLTPLQEEMASLLQQIEIERSLYSDHELRALDEDILLAQDLEDMWEQKFLQFKLGARITGCDPFRPARRKGKGVFGFPNKRQLLGPCFVF

SEQ ID NO: 896948 - protein, 233 aa, Homo sapiens
AAEGSLGAAVHCGRTKDGGARKADAVRGGGGLAAVREALGRQSKLSQPGSCSRTLKQRIPMALVGRVVPAAATCSLQAVDPIAGRDGVSTAAEADEKNDRTSLNRKLDRNLVLLVREKFGDQDVWILPQAEWQPGETLRGTAERTLATLSENNMEAKFLGNAPCGHYTFKFPQAMRTESNLGAKVFFFKALLLTGDFSQAGNKGHHVWVTKDELGDYLKPKYLAQVRRFVSDL

SEQ ID NO: 896949 - protein, 295 aa, Homo sapiens; identical to SEQ ID NO: 896941

SEQ ID NO: 896950 - protein, 1048 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 896951 - protein, 1061 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGLGGCQCLLPMKLNFTSSFEKRMVKATEISCDCTVHKTYEESARNTTVV

SEQ ID NO: 896952 - protein, 131 aa, Homo sapiens
MGSKFRLHKKIKPATKKRKEGPQMISLPFSGSLGFASLSVYMAFCPPSEPLLSLCQHAQAKIDVIKLMKLKRIRLIRLRGKKGLGGCQCLLPMKLNFTSSFEKRMVKATEISCDCTVHKTYEESARNTTVV

SEQ ID NO: 896953 - protein, 1048 aa, Homo sapiens; identical to SEQ ID NO: 896950

SEQ ID NO: 896954 - protein, 1015 aa, Homo sapiens [sequence omitted]

SEQ ID NO: 896955 - protein, 756 aa, Homo sapiens
AAAAAAKNCSFHLFSPGRTGAAAANPGRGQHAASRRAPPPGSGPDTRGERENGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSTEYQDIETEKTCPESHSPSEDSFVRS

SEQ ID NO: 896956 - protein, 774 aa, Homo sapiens
AAAAAAKNCSFHLFSPGRTGAAAANPGRGQHAASRRAPPPGSGPDTRGERENGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSEFFASTLTLDNLGRDPVPANQTHRTKFIYNLEDHEWCENMESVL

SEQ ID NO: 896957 - protein, 490 aa, Homo sapiens [sequence omitted]

SEQ ID NO: 896958 - protein, 815 aa, Homo sapiens
AAAAAAKNCSFHLFSPGRTGAAAANPGRGQHAASRRAPPPGSGPDTRGERENGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGPSKINHHYFNVKAGKDIRSCDIINFFAGLARAMGIQWDITGFIPPPLIFGAGIDSTCLFWSTFCGEQGACVLYDNVVYRYLYVSIAIALKSFAFILYTTTWQCLRKNYKRYIKNHEGGLSTSEFFASTLTLDNLGRDPVPANQTHRTKFIYNLEDHEWCENMESVL

SEQ ID NO: 896959 - protein, 761 aa, Homo sapiens
AAAAAAKNCSFHLFSPGRTGAAAANPGRGQHAASRRAPPPGSGPDTRGERENGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTTSEPDRIQNKERMTSCGRVLEATRAAGPQSLL

SEQ ID NO: 896960 - protein, 802 aa, Homo sapiens
AAAAAAKNCSFHLFSPGRTGAAAANPGRGQHAASRRAPPPGSGPDTRGERENGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGPSKINHHYFNVKAGKDIRSCDIINFFAGLARAMGIQWDITGFIPPPLIFGAGIDSTCLFWSTFCGEQGACVLYDNVVYRYLYVSIAIALKSFAFILYTTTWQCLRKNYKRYIKNHEGGLSTTSEPDRIQNKERMTSCGRVLEATRAAGPQSLL

SEQ ID NO: 896961 - protein, 675 aa, Homo sapiens
AAAAAAKNCSFHLFSPGRTGAAAANPGRGQHAASRRAPPPGSGPDTRGERENGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGTEYQDIETEKTCPESHSPSEDSFVRS

SEQ ID NO: 896962 - protein, 564 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPGYTQPSAISSVPPQPPYYPSNGYQSGYPVVPPPQQPVQPPYGVPSIVPPAVSLAPGVLPALPTGVPPVPTQYPITQVQPPASTGQSPMGGPFIPAAPVKTALPAGPQPQPQPQPPLPSQPQAQKRRFTEELPDERESGLLGYQHGPIHMTNLGTGFSSQNEIEGAGSKPASSSGKERERDRQLMPPPAFPVTGIKTESDERNGSGTLTGSHGECDIAGGTGEWLRLV

SEQ ID NO: 896963 - protein, 384 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPAASSTSLRSTKHSATSCFISTWSLAGITYWSPTCANTIPDNTSAASS

SEQ ID NO: 896964 - protein, 306 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYIRFMLNTLDL

SEQ ID NO: 896965 - protein, 384 aa, Homo sapiens; identical to SEQ ID NO: 896963

SEQ ID NO: 896966 - protein, 384 aa, Homo sapiens; identical to SEQ ID NO: 896963

SEQ ID NO: 896967 - protein, 384 aa, Homo sapiens; identical to SEQ ID NO: 896963

SEQ ID NO: 896968 - protein, 384 aa, Homo sapiens; identical to SEQ ID NO: 896963

SEQ ID NO: 896969 - protein, 384 aa, Homo sapiens; identical to SEQ ID NO: 896963

SEQ ID NO: 896970 - protein, 292 aa, Homo sapiens
RAAGIGTRSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVHQPAPIAQLSPAVSQKPPFQSGMHYVQDKLFVGLEHAVPTFNVKEKVEGPGCSYLQHIQIETGAKVFLRGKGSGCIEPASGREAFEPMYIYIRFMLNTLDL

SEQ ID NO: 896971 - protein, 166 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGCIMFKINYLWV

SEQ ID NO: 896972 - protein, 370 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGHPKPEGLAAAKKLCENLLQTVHAEYSRFVNQINTAVPLPGYTQPSAISSVPPQPPYYPSNGYQSGYPVVPPPQQPVQPPYGVPSIVPPAVSLAPGVLPALPTGVPPVPTQYPITQVQPPASTGQSPMGGPFIPAAPSQVSPRHRRDDSQRSYQMNGNLDCLDTRLNKIPCFPIFTLFFYYILPLKKINSHHSPSTRISAFWNSFWLGFLSYSTDS

SEQ ID NO: 896973 - protein, 384 aa, Homo sapiens; identical to SEQ ID NO: 896963

SEQ ID NO: 896974 - protein, 384 aa, Homo sapiens; identical to SEQ ID NO: 896963

SEQ ID NO: 896975 - protein, 384 aa, Homo sapiens; identical to SEQ ID NO: 896963

SEQ ID NO: 896976 - protein, 105 aa, Homo sapiens
MRLRLKKKFLMALVLELCNQTLVNAQLRLSHVNLFPPLFVHAEYSRFVNQINTAVPLPAASSTSLRSTKHSATSCFISTWSLAGITYWSPTCANTIPDNTSAASS

SEQ ID NO: 896977 - protein, 174 aa, Homo sapiens [sequence omitted]

SEQ ID NO: 896978 - protein, 155 aa, Homo sapiens
CAAPRTGNSAGSAMAAAAEGVLATRSDEPARDDAAVETAEEAKEPAEADITELCRDMFSKMATYLTGELTATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 896979 - protein, 126 aa, Homo sapiens
MFRYGEYLCPPIMFAPPPRMIMGSSVPPQNFFSPVCPLFAQLRRRCVFIIAPPLAALWGFYYTPPSFWGGPLVSTKNGGPAPKLGPPRGGIFLARGPPSFFFFFFFFFFFFFVSLFFFFFFFFMVF

SEQ ID NO: 896980 - protein, 155 aa, Homo sapiens; identical to SEQ ID NO: 896978

SEQ ID NO: 896981 - protein, 155 aa, Homo sapiens; identical to SEQ ID NO: 896978

SEQ ID NO: 896982 - protein, 155 aa, Homo sapiens; identical to SEQ ID NO: 896978

SEQ ID NO: 896983 - protein, 74 aa, Homo sapiens
CAAPRPGNSAGSAMAAAAEGVLATRSDEPARDDAAVETAEEAKEPAEADITELCRDMFSKMATYLTGELTELRD

SEQ ID NO: 896984 - protein, 170 aa, Homo sapiens
CAAPRTGNSAGSAMAAAAEGVLATRSDEPARDDAAVETAEEAKEPAEADITELCRDMFSKMATYLTGELTATSEDYKLLENMNKLTSLKYLEMKDIAINISRNLKDLNQKYAGLQPYLDQINVIEEQVAALEQAAYKLDAYSKKLGNRFYFCFDVIKTASCQHILSKHNS

SEQ ID NO: 896985 - protein, 155 aa, Homo sapiens; identical to SEQ ID NO: 896978

SEQ ID NO: 896986 - protein, 172 aa, Homo sapiens
SEGLEIMADGEWSRLDGMKASGGMSEQAALAGLAPGVGGTLESFSLGPDDAAVETAEEAKEPAEADITELCRDMFSKMATYLTGELTATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 896987 - protein, 638 aa, Homo sapiens
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 896988 - protein, 184 aa, Homo sapiens
ANGRAADRVSEKEAEAGRSRCQSQTASAAASPWHDPGLRLQRLHKAAFLGAAVSLLDSCCATWTVEERLPSFHPTANPKASTLLPSERTFDAGPLERLIDKPAPLGPPEQSLLTQLPTFAALMPSHVCLILRRLPQVSIVWEERSNESHAEKGLESTLWRTQCNCDEANHEGPLFNSPLTCSRG

SEQ ID NO: 896989 - protein, 824 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896990 - protein, 912 aa, Homo sapiens
MGELPTGCRKRRRKRGGAAARARLHPPRRLHGTTLASDFNDFIRRRFWAQPCRSWFPSCGKNGVTSLTQKKVLRAPCGAPSVTVTKPTMKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896991 - protein, 873 aa, Homo sapiens
MGELPTGCRKRRRKRGGAAARARLHPPRRLHGTTLASDFNDFIRRRFWAQPCRSWFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896992 - protein, 829 aa, Homo sapiens
MSASSSGGSPRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896993 - protein, 810 aa, Homo sapiens
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896994 - protein, 810 aa, Homo sapiens
MGRNRYPPACWFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896995 - protein, 767 aa, Homo sapiens
MKDRSSTPPLHVHVDENTPVHVHIKKLPKPSATSSQKSHKRGMKGDTVNVRRSVRVKTKVPWMPPGKSSARPVGCKWEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896996 - protein, 753 aa, Homo sapiens
MSASSSGGSPRFPSCGKNGVTSLTQKKVLRAPCGAPSVTVTKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896997 - protein, 650 aa, Homo sapiens
MRLSDLSTEDDDSGQLQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 896998 - protein, 589 aa, Homo sapiens [sequence omitted]

SEQ ID NO: 896999 - protein, 484 aa, Homo sapiens
VFPNCSMKRKVKLCELKAHITKENLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897000 - protein, 732 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERLEALGPISVLFLGPETFSHLAVFCLVCGSVEGLEALEGTRQTSEEKLLPFQWKLEATSAQNIEFLI

SEQ ID NO: 897001 - protein, 183 aa, Homo sapiens [sequence omitted]

SEQ ID NO: 897002 - protein, 235 aa, Homo sapiens
MAREKHQASQKENKQLSLKVDELERLEALGPISVLFLGPETFSHLAVFCLVCGSVEGLEALEGTRQTSEEKLLPFQWKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897003 - protein, 700 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGNVTCKYTKQQQKTHTFDEPLLSVSGVGAKTRPRPLDTGAQLGSFTCVSLDPTLSFVTHGWLNSLAAALPHFCDLRLTFSRYNAPGSYSCIHATSGDDLPPRAMRPPRRARPLLASPDSDRPRRPRSPSSHSALPRPRHPPPLPASPPSPLCPASPPLSVPPPPP

SEQ ID NO: 897004 - protein, 308 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSEQTNWRQKDTVKPLAVATSENGAGCYCGDR

SEQ ID NO: 897005 - protein, 66 aa, Homo sapiens
QQLKASVKNYEGMIDNYKSQVGLTGALALLSSALPAPIRLGAPYQATPREGWVWKMVFIKTWLYLR

SEQ ID NO: 897006 - protein, 805 aa, Homo sapiens
MKDRSSTPPLHVHVDENTPVHVHIKKLPKPSATSSQKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897007 - protein, 125 aa, Homo sapiens
AFKKETEGDDLNYEEFKVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 897008 - protein, 78 aa, Homo sapiens
PSTSHFQHLITPSNISWRKKVLRAPCGAPSVTVTKPTMKDRSSTPPLHVHVDENTPVHVHIKKLPKPSATSSQKSHKR

SEQ ID NO: 897009 - protein, 824 aa, Homo sapiens; identical to SEQ ID NO: 896989

SEQ ID NO: 897010 - protein, 805 aa, Homo sapiens; identical to SEQ ID NO: 897006

SEQ ID NO: 897011 - protein, 854 aa, Homo sapiens
MGELPTGCRKRRRKRGGAAARARLHPPRRLHGTTLASDFNDFIRRRFWAQPCRSWFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897012 - protein, 810 aa, Homo sapiens; identical to SEQ ID NO: 896993

SEQ ID NO: 897013 - protein, 748 aa, Homo sapiens
MKDRSSTPPLHVHVDENTPVHVHIKKLPKPSATSSQKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897014 - protein, 687 aa, Homo sapiens
SSSCPPKSQNMSRAFPTSTVPCVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897015 - protein, 876 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERLEALGPISVLFLGPETFSHLAVFCLVCGSVEGLEALEGTRQTSEEKLLPFQWKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897016 - protein, 701 aa, Homo sapiens
MGELPTGCRKRRRKRGGAAARARLHPPRRLHGTTLASDFNDFIRRRFWAQPCRSWFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 897017 - protein, 824 aa, Homo sapiens; identical to SEQ ID NO: 896989

SEQ ID NO: 897018 - protein, 159 aa, Homo sapiens
MKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 897019 - protein, 552 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKCQDQLQGYERKNIDLTAIISDLRSRVRDWQKGSHELTRAGARIPR

SEQ ID NO: 897020 - protein, 112 aa, Homo sapiens
MKDRSSTPPLHVHVDENTPVHVHIKKLPKPSATSSQKSHKRGMKGDTVNVRRSVRVKTKVPWMPPGKSSARPVGCKWEVGSPLPRLFFSDCSDPSRPQPRYDSGSAIATGMS

SEQ ID NO: 897021 - protein, 795 aa, Homo sapiens
TAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYQQKQGLQPVPLQATMSAATGIQPSPVNVVGVTSALGQQPSISSLAQPQLPYSQAAPPVQTPLPGAPPPQQLQYGQQQPMVSTQMAPGHVKSVTQNPASEYVQQQPILQTAMSSGQPSSAGVGAGTTVIPVAQPQGIQLPVQPTAVPAQPAGASVQPVGQAPAAVSAVPTGSQIANIGQQANIPTAVQQPSTQVPPSVIQQGAPPSSQVVPPAQTGIIHQGVQTSAPSLPQQLVIASQSSLLTVPPQPQGVEPVAQGIVSQQLPAVSSLPSASSISVTSQVSSTGPSGMPSAPTNLVPPQNIAQTPATQNGNLVQSVSQPPLIATNTNLPLAQQIPLSSTQFSAQSLAQAIGSQIEDARRAAEPSLVGLPQTISGDSGGMSAVSDGSSSSLAASASLFPLKVLPLTTPLVDGEDESSSGASVVAIDNKIEQAMDLVKSHLMYAVREEVEVLKEQIKELIEKNSQLEQENNLLKTLASPEQLAQFQAQLQTGLPPCHHPATGHHTAPRPASIAGLRTNRIAAYAPAELAAACELNRRRRCARENLPPQSPISLLAAKET

SEQ ID NO: 897022 - protein, 681 aa, Homo sapiens
TAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYQQKQGLQPVPLQATMSAATGIQPSPVNVVGVTSALGQQPSISSLAQPQLPYSQAAPPVQTPLPGAPPPQQLQYGQQQPMVSTQMAPGHVKSVTQNPASEYVQQQPILQTAMSSGQPSSAGVGAGTTVIPVAQPQGIQLPVQPTAVPAQPAGASVQPVGQAPAAVSAVPTGSQIANIGQQANIPTAVQQPSTQVPPSVIQQGAPPSSQVVPPAQTGIIHQGVQTSAPSLPQQLVIASQSSLLTVPPQPQGVEPVAQGIVSQQLPAVSSLPSASSISVTSQVSSTGPSGMPSAPTNLVPPQNIAQTPATQNGNLVQSVSQPPLIATNTNLPLAQQIPLSSTQFSAQSLAQAIGSQIEDARRAAEPSLVGLPQTISGDSGGMSAVSDGSSSSLAASASLFPLKVLPLTTPLVDGEDESSLFQCFSPTRGARSDPRTTDTAKTTESF

SEQ ID NO: 897023 - protein, 184 aa, Homo sapiens
MKSQWCRPVAMDLGVYQLRHFSISFLSSLLGTENASVRLDNSSSGASVVAIDNKIEQAMDLVKSHLMYAVREEVEVLKEQIKELIEKNSQLEQENNLLKTLASPEQLAQFQAQLQTGLPPCHHPATGHHTAPRPASIAGLRTNRIAAYAPAELAAACELNRRRRCARENLPPQSPISLLAAKET

SEQ ID NO: 897024 - protein, 184 aa, Homo sapiens; identical to SEQ ID NO: 897023

SEQ ID NO: 897025 - protein, 184 aa, Homo sapiens; identical to SEQ ID NO: 897023

SEQ ID NO: 897026 - protein, 126 aa, Homo sapiens
MDLVKSHLMYAVREEVEVLKEQIKELIEKNSQLEQENNLLKTLASPEQLAQFQAQLQTGLPPCHHPATGHHTAPRPASIAGLRTNRIAAYAPAELAAACELNRRRRCARENLPPQSPISLLAAKET

SEQ ID NO: 897027 - protein, 126 aa, Homo sapiens; identical to SEQ ID NO: 897026

SEQ ID NO: 897028 - protein, 126 aa, Homo sapiens; identical to SEQ ID NO: 897026

SEQ ID NO: 897029 - protein, 158 aa, Homo sapiens
GAWGARGQWCEMKLQSSSGASVVAIDNKIEQAMDLVKSHLMYAVREEVEVLKEQIKELIEKNSQLEQENNLLKTLASPEQLAQFQAQLQTGLPPCHHPATGHHTAPRPASIAGLRTNRIAAYAPAELAAACELNRRRRCARENLPPQSPISLLAAKET

SEQ ID NO: 897030 - protein, 126 aa, Homo sapiens; identical to SEQ ID NO: 897026

SEQ ID NO: 897031 - protein, 145 aa, Homo sapiens
MQLEQVFLSSKSSTASNTLTDLVKSHLMYAVREEVEVLKEQIKELIEKNSQLEQENNLLKTLASPEQLAQFQAQLQTGLPPCHHPATGHHTAPRPASIAGLRTNRIAAYAPAELAAACELNRRRRCARENLPPQSPISLLAAKET

SEQ ID NO: 897032 - protein, 118 aa, Homo sapiens
MYAVREEVEVLKEQIKELIEKNSQLEQENNLLKTLASPEQLAQFQAQLQTGLPPCHHPATGHHTAPRPASIAGLRTNRIAAYAPAELAAACELNRRRRCARENLPPQSPISLLAAKET

SEQ ID NO: 897033 - protein, 184 aa, Homo sapiens; identical to SEQ ID NO: 897023

SEQ ID NO: 897034 - protein, 184 aa, Homo sapiens; identical to SEQ ID NO: 897023

SEQ ID NO: 897035 - protein, 184 aa, Homo sapiens; identical to SEQ ID NO: 897023

SEQ ID NO: 897036 - protein, 121 aa, Homo sapiens
MPMGVRTKFGINMVTSRERGTTRLPKEEVNRPRSETEQVKTPVLISSGIAPVNSQLHSSLSNIARPRLVQIYRDLMQLGRYLRNGLIHAQELCAFPSLPAPYPSLPRVLSPCLRLVSYMGL

SEQ ID NO: 897037 - protein, 132 aa, Homo sapiens
MKSQWCRPVAMDLGVYQLRHFSISFLSSLLGTENASVRLDNSSSGASVVAIDNKIEQAMDLVKSHLMYAVREEVEVLKEQIKELIEKNSQLEQENNLLKTLASPEQLAQFQAQLQTGLPPCHHPATARATFS

SEQ ID NO: 897038 - protein, 681 aa, Homo sapiens; identical to SEQ ID NO: 897022

SEQ ID NO: 897039 - protein, 419 aa, Homo sapiens
PEPRPSGPGSARPACQPRCCCSSCCGTADRAAAPLSPLQAPIWAPATSMDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 897040 - protein, 419 aa, Homo sapiens; identical to SEQ ID NO: 897039

SEQ ID NO: 897041 - protein, 498 aa, Homo sapiens
PEPRPSGPGSARPACQPRCCCSSCCGTADRAAAPLSPLQAPIWAPATSMDARRVPQKDLRVKKNLKKFRYVKLISMETSSSSDDSCDSFASDNFANTKPKFRSDISEELANVFYEDSDNESFCGFSESEVQDVLDHCGFLQKPRPDVTNELAGIFHADSDDESFCGFSESEIQDGMRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 897042 - protein, 498 aa, Homo sapiens; identical to SEQ ID NO: 897041

SEQ ID NO: 897043 - protein, 394 aa, Homo sapiens
NLKKFRYVKFFFTLRSFCGTRRASMLVAGAQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 897044 - protein, 242 aa, Homo sapiens
PEPRPSGPGSARPACQPRCCCSSCCGTADRAAAPLSPLQAPIWAPATSMDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSVSTSSCLYTVVFWAHLRSICVVFKNLISLFVWPSRQTKGT

SEQ ID NO: 897045 - protein, 498 aa, Homo sapiens; identical to SEQ ID NO: 897041

SEQ ID NO: 897046 - protein, 291 aa, Homo sapiens
PEPRPSGPGSARPACQPRCCCSSCCGTADRAAAPLSPLQAPIWAPATSMDARRVPQKDLRVKKNLKKFRYVKLISMETSSSSDDSCDSFASDNFANTKPKFRSDISEELANVFYEDSDNESFCGFSESEVQDVLDHCGFLQKPRPDVTNELAGIFHADSDDESFCGFSESEIQDGMRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSTNEGDLEETP

SEQ ID NO: 897047 - protein, 179 aa, Homo sapiens
PEPRPSGPGSARPACQPRCCCSSCCGTADRAAAPLSPLQAPIWAPATSMDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMVGI

SEQ ID NO: 897048 - protein, 443 aa, Homo sapiens
MDSRAQLWGLALNKRRATLPHPGGSTNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 897049 - protein, 534 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 897050 - protein, 534 aa, Homo sapiens; identical to SEQ ID NO: 897049

SEQ ID NO: 897051 - protein, 534 aa, Homo sapiens; identical to SEQ ID NO: 897049

SEQ ID NO: 897052 - protein, 427 aa, Homo sapiens
TGARVGLELPNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 897053 - protein, 515 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 897054 - protein, 534 aa, Homo sapiens; identical to SEQ ID NO: 897049

SEQ ID NO: 897055 - protein, 444 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIRVFSHRTWTEIR

SEQ ID NO: 897056 - protein, 534 aa, Homo sapiens; identical to SEQ ID NO: 897049

SEQ ID NO: 897057 - protein, 371 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTLQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 897058 - protein, 496 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAEPSARRPSRDTHSLHCAAAR

SEQ ID NO: 897059 - protein, 534 aa, Homo sapiens; identical to SEQ ID NO: 897049

SEQ ID NO: 897060 - protein, 523 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQR

SEQ ID NO: 897061 - protein, 554 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRSIHGNQAPPDCHLAQVQAFGGSGCVLGSRSV

SEQ ID NO: 897062 - protein, 534 aa, Homo sapiens; identical to SEQ ID NO: 897049

SEQ ID NO: 897063 - protein, 523 aa, Homo sapiens; identical to SEQ ID NO: 897060

SEQ ID NO: 897064 - protein, 464 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKVRLLTPEWPR

SEQ ID NO: 897065 - protein, 431 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHSRSSPGRLKKELLLRSAPAVAPADLTSSRLGRALRESSGLENTGNLSGSKLFCKPDE

SEQ ID NO: 897066 - protein, 336 aa, Homo sapiens
SGQRARAQAARLQPSSSGSSGGGGSAREALRPQQLLPGAVHGDAARHPPLSPRRPAGTRQAGVASGSGRPRRPRAARGPRASPPRADRRGPAVPSQEVAVLSAMAHSPVQSGLPGMQNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSECTPAWATRAKLS

SEQ ID NO: 897067 - protein, 126 aa, Homo sapiens
KGIDNRTQKVVAIKIIDLEEAEDEIEDIQQEITVLSQCDSPYVTKYYGSYLKVRLKITCFSVLQHLAEVPAGNGKDSDRTKHSRFQSKERCFDLRDQKNLALIVPSSQMSPIEIFVVKVFDVLILF

SEQ ID NO: 897068 - protein, 485 aa, Homo sapiens
MALPPFFGQGRPGPPPPQPPPPAPFGCPPPPLPSPAFPPPLPQRPGPFPGASAPFLQPPLALQPRASAEASRGGGGAGAFYPVPPPPLPPPPPQCRPFPGTDAGERPRPPPPGPGPPWSPRWPEAPPPPADVLGDAALQRLRDRQWLEAVFGTPRRAGCPVPQRTHAGPSLGEVRARLLRALRLVRRLRGLSQALREAEADGAAWVLLYSQTAPLRAELAERLQPLTQAAYVGEARRRLERVRRRRLRLRERAREREAEREAEAARAVEREQEIDRWRVKCVQEVEEKKREQELKAAADGVLSEVRKKQADTKRMVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVPSDHPKGNFVPQGWVLPPLPSNDIWATAVKLH

SEQ ID NO: 897069 - protein, 171 aa, Homo sapiens
MVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVPSDHPKGNFVPQGWVLPPLPSNDIWATAVKLH

SEQ ID NO: 897070 - protein, 171 aa, Homo sapiens; identical to SEQ ID NO: 897069

SEQ ID NO: 897071 - protein, 425 aa, Homo sapiens
MALPPFFGQGRPGPPPPQPPPPAPFGCPPPPLPSPAFPPPLPQRPGPFPGASAPFLQPPLALQPRASAEASRGGGGAGAFYPVPPPPLPPPPPQCRPFPGTDAGERPRPPPPGPGPPWSPRWPEAPPPPADVLGDAALQRLRDRQWLEAVFGTPRRAGCPVPQRTHAGPSLGEVRARLLRALRLVRRLRGLSQALREAEADGAAWVLLYSQTAPLRAELAERLQPLTQAAYVGEARRRLERVRRRRLRLRERAREREAEREAEAARAVEREQEIDRWRVKCVQEVEEKKREQELKAAADGVLSEVRKKQADTKRMVDILRALEKLRKLRKEAAARKGVCPPASADETFTHHLQRLRKLIKKRSELYEAEERALRVMLEGEQEEERKRELEKKQRKEKEKILLQKREIESKLFGDPGMLLYNQWRK

SEQ ID NO: 897072 - protein, 273 aa, Homo sapiens
LLLNSRPGRRNMKRHEMVVAKHSALCSRFAQDLWLEQNIKDSFQKVTLSRYGKYGHKNLQLRKGCKSVDECKGHQGGYNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 897073 - protein, 308 aa, Homo sapiens
MTSSGSGGVFVSLQRVLQVWPSLFCVLLLLEAQPLWRCDLVIGRFTAKTPGSPEKPRNALCSRFAQDLWLEQNIKDSFQKVTLSRYGKYGHKNLQLRKGCKSVDECKGHQGGYNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 897074 - protein, 915 aa, Homo sapiens [sequence omitted]

SEQ ID NO: 897075 - protein, 125 aa, Homo sapiens
MTRHADRIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDWRVALG

SEQ ID NO: 897076 - protein, 863 aa, Homo sapiens [sequence omitted]

SEQ ID NO: 897077 - protein, 863 aa, Homo sapiens [sequence omitted]

SEQ ID NO: 897078 - protein, 845 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGRMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897079 - protein, 870 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGRMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEAETRKFRGSRNENKENINGNFEPRKERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897080 - protein, 841 aa, Homo sapiens
MTRHADRIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGRMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897081 - protein, 431 aa, Homo sapiens
PKLGTRARIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897082 - protein, 351 aa, Homo sapiens
MCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897083 - protein, 335 aa, Homo sapiens
VMSSVPPSTLFFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897084 - protein, 863 aa, Homo sapiens [sequence omitted]

SEQ ID NO: 897085 - protein, 863 aa, Homo sapiens [sequence omitted]

SEQ ID NO: 897086 - protein, 162 aa, Homo sapiens
GPRVSSVADWVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897087 - protein, 109 aa, Homo sapiens
MYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897088 - protein, 650 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGRMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEGSKRSLTNLDQGVPGPWSVVSPRGFQQ

SEQ ID NO: 897089 - protein, 461 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEESSYGSPFTPAKRPKRKVAPKRRQERPVAPPKKRRRKIHRMDHYAAETRQDKMTNPLREIDKIVGQLMDGLCTGSDAEKGKEEIRVPQMGFYQISGKLVSCFLSRPTHRITVGRQNPRLFRSGSLGKESRGKVPKSL

SEQ ID NO: 897090 - protein, 159 aa, Homo sapiens
MYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 897091 - protein, 828 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGRMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSPEDESQRVEESMKTHTARVRWTLDIGAPDNEPARDSKT

SEQ ID NO: 897092 - protein, 616 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGRMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGPTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEGKGWLQNNQIRFFSFSKIEKASYLHYSVSTILFKIRICISK

SEQ ID NO: 897093 - protein, 336 aa, Homo sapiens
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHNFVDFPQRICHLRAKGPYLV

SEQ ID NO: 897094 - protein, 111 aa, Homo sapiens
MPVAERLTDHLSQDVFCLHESKFEEERMVAGWLTNYSQDSVTFEDVAVDFTQEEWTLLDQTQRNLYRDVMLENYKNLVAVDWESHINTKWSAPQQNFLQGKTSSVVEMNSE

SEQ ID NO: 897095 - protein, 565 aa, Homo sapiens
MPVAERLTDHLSQDVFCLHESKFEEERMVAGWLTNYSQDSVTFEDVAVDFTQEEWTLLDQTQRNLYRDVMLENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 897096 - protein, 112 aa, Homo sapiens
MLAIGLSLCDHLSQDVFCLHESKFEEERMVAGWLTNYSQDSVTFEDVAVDFTQEEWTLLDQTQRNLYRDVMLENYKNLVAVDWESHINTKWSAPQQNFLQGKTSSVVEMNSE

SEQ ID NO: 897097 - protein, 112 aa, Homo sapiens; identical to SEQ ID NO: 897096

SEQ ID NO: 897098 - protein, 111 aa, Homo sapiens; identical to SEQ ID NO: 897094

SEQ ID NO: 897099 - protein, 112 aa, Homo sapiens; identical to SEQ ID NO: 897096

SEQ ID NO: 897100 - protein, 111 aa, Homo sapiens; identical to SEQ ID NO: 897094

SEQ ID NO: 897101 - protein, 321 aa, Homo sapiens
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINMNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCFQCEKAFSTSTNLIMHKRIHNGQKLHE

SEQ ID NO: 897102 - protein, 271 aa, Homo sapiens
MSFSLHSSCSVREQIPTGEKGDECSDYGKISPLSVHTKTGSVEEGLECNEHEKTFTDPLSLQNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCFQCEKAFSTSTNLIMHKRIHNGQKLHE

SEQ ID NO: 897103 - protein, 321 aa, Homo sapiens; identical to SEQ ID NO: 897101

SEQ ID NO: 897104 - protein, 321 aa, Homo sapiens; identical to SEQ ID NO: 897101

SEQ ID NO: 897105 - protein, 321 aa, Homo sapiens; identical to SEQ ID NO: 897101

SEQ ID NO: 897106 - protein, 271 aa, Homo sapiens; identical to SEQ ID NO: 897102

SEQ ID NO: 897107 - protein, 481 aa, Homo sapiens [sequence omitted]

SEQ ID NO: 897108 - protein, 311 aa, Homo sapiens [sequence omitted]

SEQ ID NO: 897109 - protein, 311 aa, Homo sapiens [sequence omitted]

SEQ ID NO: 897110 - protein, 311 aa, Homo sapiens [sequence omitted]

SEQ ID NO: 897111 - protein, 263 aa, Homo sapiens
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGEQRAQAPRVRMCRLRC

SEQ ID NO: 897112 - protein, 263 aa, Homo sapiens; identical to SEQ ID NO: 897111

SEQ ID NO: 897113 - protein, 263 aa, Homo sapiens; identical to SEQ ID NO: 897111

SEQ ID NO: 897114 - protein, 357 aa, Homo sapiens
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVATRWRHEPKSSPVPQPTPLAGFPTSLRMKAQVIRVARQALHDVPRHLPALPSFALGLPHQNGSQESQPGTGPSLALGQQVMSWEQLLGQRLTGNKRPGRVWPRAAGLTKSH

SEQ ID NO: 897115 - protein, 288 aa, Homo sapiens
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGLNVHSMLKHQTLVLTLPTVAFLEDKLLWQDSRYRPLGPPGS

SEQ ID NO: 897116 - protein, 307 aa, Homo sapiens
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGLNVHSMLKHQTLVLTLPTVAFLEDKLLWQDSRYRPLQDGAGGFCASPGARLLRRGAGPGR

SEQ ID NO: 897117 - protein, 221 aa, Homo sapiens [sequence omitted]

SEQ ID NO: 897118 - protein, 324 aa, Homo sapiens
MLQHVLSRGCRGSGVCALAISGGIVYFALAGIERNQQCAPEETREPGGGADGLSRVLGACAIGLCLPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGLNVHSMLKHQTLVLTLPTVAFLEDKLLWQDSRYRPLYPFSLPYSDFPRPLPHATQGPAATPYHC

SEQ ID NO: 897119 - protein, 220 aa, Homo sapiens
MKFGGVQGSSLTFAQPLQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDL

SEQ ID NO: 897120 - protein, 188 aa, Homo sapiens
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKRPPRTTVDVKHLF

SEQ ID NO: 897121 - protein, 174 aa, Homo sapiens
MLQFVRAGARAWLRPTGSQGSSLTFAQPLQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGFAHWPPGNKFINL

SEQ ID NO: 897122 - protein, 170 aa, Homo sapiens
MGKRYFCDYCDRSFQDNLHNRKKHLNGLQHLKAKKVWYDMFRDAAAILLDEQNKRPCRKFLLTGQCDFGSNCRFSHMSERDLQELSIQVEEERRAREWLLDAPELPEGHLEDWLEKRAKRLSSAPSSRAEPIRTTVFQYPVGWPPVQELPPSLRAPPPGGWPLQPRVQWG

SEQ ID NO: 897123 - protein, 170 aa, Homo sapiens; identical to SEQ ID NO: 897122

SEQ ID NO: 897124 - protein, 170 aa, Homo sapiens; identical to SEQ ID NO: 897122

SEQ ID NO: 897125 - protein, 131 aa, Homo sapiens
MFRDAAAILLDEQNKRPCRKFLLTGQCDFGSNCRFSHMSERDLQELSIQVEEERRAREWLLDAPELPEGHLEDWLEKRAKRLSSAPSSRAEPIRTTVFQYPVGWPPVQELPPSLRAPPPGGWPLQPRVQWG

SEQ ID NO: 897126 - protein, 170 aa, Homo sapiens; identical to SEQ ID NO: 897122

SEQ ID NO: 897127 - protein, 109 aa, Homo sapiens
MGKRYFCDYCDRSFQDNLHNRKKHLNGLQHLKAKKVWYDMFRDAAAILLDEQNKRPCRKFLLTGQCDFGSNCRFSHMSERDLQELSIQVEEKRAKRLSSAPSSSSHQSQ

SEQ ID NO: 897128 - protein, 170 aa, Homo sapiens; identical to SEQ ID NO: 897122

SEQ ID NO: 897129 - protein, 170 aa, Homo sapiens; identical to SEQ ID NO: 897122

SEQ ID NO: 897130 - protein, 175 aa, Homo sapiens
MGKRYFCDYCDRSFQDNLHNRKKHLNGLQHLKAKKVWYDMFRDAAAILLDEQNKRPCRKFLLTGQCDFGSNCRFSHMSERDLQELSIQVEEERRAREWLLDAPELPEGHLEDWLEKRAKRLSSAPSSRPHGILCCGRAYVLNQSPTGGHEGYSHCLAAQCLPATPLFPWAQFLEG

SEQ ID NO: 897131 - protein, 221 aa, Homo sapiens
MSSRPGREDVGAAGARRPREPPEQELQRRREQKRRRHDAQQLQQLKHLESFYEKPPPGLIKEDETKPEDCIPDVPGNEHAREFLAHAPTKGLWMPLGKEVKVMQCWRCKRYGHRTGDKECPFFIKGNQKLEQFRVAHEDPMYDIIRDNKRHEKDVRIQQLKQLLEDSTSDEDRSSSSSSEGKEKHKKKKKKEKHKKRKKEKKKKKKRKHKSSKSNEGSDSE

SEQ ID NO: 897132 - protein, 207 aa, Homo sapiens
KHLAFRISFPSCCLSHLETCVLSILGLLWVQSLDGNKEGLASLRWQVPLSTEEEKHSALLSYEKPPPGLIKEDETKPEDCIPDVPGNEHAREFLAHAPTKGLWMPLGKEVKVMQCWRCKRYGHRTGDKECPFFIKGNQKLEQFRVAHEDPMYDIIRDNKRHEKDVRIQQLKQLLEDSTSDEDRSSSSSSEGKEKHKKKKKKEKHKKK

SEQ ID NO: 897133 - protein, 112 aa, Homo sapiens
MQSRSLVQASRLQLPFFIKGNQKLEQFRVAHEDPMYDIIRDNKRHEKDVRIQQLKQLLEDSTSDEDRSSSSSSEGKEKHKKKKKKEKHLKKRGKIKERKTFSEACQQYNHYS

SEQ ID NO: 897134 - protein, 148 aa, Homo sapiens
MSSRPGREDVGAAGARRPREPPEQELQRRREQKRRRHDAQQLQQLKHLESFYEKPPPGLIKEDETKPEDCIPDVPGNEHAREFLAHAPTKGLWMPLGKEVKVMQCECGRVSLIHATYMPQFTKSVYFFYLTCSHHSPLTAKARSPSSR

SEQ ID NO: 897135 - protein, 172 aa, Homo sapiens
KARYEAGVESAPRIICLDLSEEMSLPKLESFNGQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 897136 - protein, 95 aa, Homo sapiens
SLIFLIQSHFILCSSVANHIPGPAAPSSRQLSLQTPPPTQFQPISFQVLSSLNQFLSLLVLQPAELHFLISEASGLRRTTSGCKDGGFLVSRRLI

SEQ ID NO: 897137 - protein, 329 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 897138 - protein, 329 aa, Homo sapiens; identical to SEQ ID NO: 897137

SEQ ID NO: 897139 - protein, 329 aa, Homo sapiens; identical to SEQ ID NO: 897137

SEQ ID NO: 897140 - protein, 358 aa, Homo sapiens
RETLAGQAGLIGRGLKEVQATVSRSHTGAMEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 897141 - protein, 329 aa, Homo sapiens; identical to SEQ ID NO: 897137

SEQ ID NO: 897142 - protein, 329 aa, Homo sapiens; identical to SEQ ID NO: 897137

SEQ ID NO: 897143 - protein, 276 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKRRGFTVLAGMVLIS

SEQ ID NO: 897144 - protein, 301 aa, Homo sapiens
MEVAEPSSPTEEEEEEEEHSAEPRPRTRSNPEGAEDRAVGAQASVGSRSEGEGEAASADDGSLNTSGIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 897145 - protein, 276 aa, Homo sapiens; identical to SEQ ID NO: 897143

SEQ ID NO: 897146 - protein, 333 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKWFPGAALFLGLDACVTIHNWHLRRTRRRIELEDMFAFMGSLDTKGTSYKYEVALAGPALELHNCMAKLLAHPLQRPCQSHASYSLLEEEDEAIEVEATV

SEQ ID NO: 897147 - protein, 337 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFTFSLAPPPDLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 897148 - protein, 159 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWPAEN

SEQ ID NO: 897149 - protein, 329 aa, Homo sapiens; identical to SEQ ID NO: 897137

SEQ ID NO: 897150 - protein, 159 aa, Homo sapiens; identical to SEQ ID NO: 897148

SEQ ID NO: 897151 - protein, 254 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 897152 - protein, 224 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFKRADDSPAICGPHHPCLQPSTLPAPVLLDGAHEENVPVPIFLL

SEQ ID NO: 897153 - protein, 192 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFTTMALRRRRRR

SEQ ID NO: 897154 - protein, 211 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFRRGMFAECVNGFCLANSSSPFRTHPRCPLF

SEQ ID NO: 897155 - protein, 111 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIIECAVRGNVNAKAAQ

SEQ ID NO: 897156 - protein, 278 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKEAEAGESLEPGRQRLR

SEQ ID NO: 897157 - protein, 257 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQSPWPKALVLKLGSLGPPGWGGSRRHVGYLAGS

SEQ ID NO: 897158 - protein, 248 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQKLGSLGPPGWGGSRRHVGYLAGS

SEQ ID NO: 897159 - protein, 159 aa, Homo sapiens; identical to SEQ ID NO: 897148

SEQ ID NO: 897160 - protein, 266 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKPGGT

SEQ ID NO: 897161 - protein, 270 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTECWPTPCSGLARAMLPTACWRRRMKPLRLRPLSEPSLYICTFLCKEVLGLKPWFSNWVPWDLRGGGVPGGT

SEQ ID NO: 897162 - protein, 166 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWPCFLQPAGGGG

SEQ ID NO: 897163 - protein, 76 aa, Homo sapiens
MEVAEPSSPTEEEESCRIRARLRWGEALTSSGDYTASGSALHSAAPWPLSFACIYSALILHDDEVTITEDKINCPH

SEQ ID NO: 897164 - protein, 67 aa, Homo sapiens
TADPGGYTEVDSVNLGRQQQTGFQEPVFDEARTEEQASKQQFVVKIGKESSSTYPGSWSWPAAKCCS

SEQ ID NO: 897165 - protein, 164 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKVRKWKCNTR

SEQ ID NO: 897166 - protein, 426 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 897167 - protein, 296 aa, Homo sapiens [sequence omitted]

SEQ ID NO: 897168 - protein, 426 aa, Homo sapiens; identical to SEQ ID NO: 897166

SEQ ID NO: 897169 - protein, 426 aa, Homo sapiens; identical to SEQ ID NO: 897166

SEQ ID NO: 897170 - protein, 374 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECALAL

SEQ ID NO: 897171 - protein, 325 aa, Homo sapiens
MAEMATATRLLGWRVASWRLRPPLAGFVSQRAHSLLPVDDAINGLSEEQRQLRQTMAKFLQEHLAPKAQEIDRSNEFKNLRVSWEARAVGGSQGVGLSCTAAWKSSHSFLEFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLG

SEQ ID NO: 897172 - protein, 277 aa, Homo sapiens
MVFWWRIGQATYRLWHKGPQSVCSSLTPEQAELRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLG

SEQ ID NO: 897173 - protein, 389 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFVSRGISS

SEQ ID NO: 897174 - protein, 266 aa, Homo sapiens
MAEMATATRLLGWRVASWRLRPPLAGFVSQRAHSLLPVDDAINGLSEEQRQEFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLG

SEQ ID NO: 897175 - protein, 426 aa, Homo sapiens; identical to SEQ ID NO: 897166

SEQ ID NO: 897176 - protein, 197 aa, Homo sapiens
SALSFIETTSEPALGSLMARAPMYSPLLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLG

SEQ ID NO: 897177 - protein, 426 aa, Homo sapiens; identical to SEQ ID NO: 897166

SEQ ID NO: 897178 - protein, 223 aa, Homo sapiens
FTPTGSMSHHRLYVTTTGSISHPRALSHTYGLCLTPTGSISHPWVSISHPRALCHNQRLYLTPMGSISRPSDPLKMGQMDLMVGLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 897179 - protein, 108 aa, Homo sapiens
MQGNLADRGPRLKCMLAIRSTSSPAPAMRAHCTCYRNCAGLWISFNSGCTCAQHRVALDGISDFGGNGYINDFPMGRFLRDAKLYEIGAGTSEVRRLVIGRAFNADFH

SEQ ID NO: 897180 - protein, 426 aa, Homo sapiens; identical to SEQ ID NO: 897166

SEQ ID NO: 897181 - protein, 487 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGQTFSAQHPPGREGETRGQTSLEQVSTARELRCKILLPELTPRVLLPQLASWISDQKLPFLKILLCSPTSLGQSSLAGFTKLRWPYPLLQPHLLPHPYTTALHLC

SEQ ID NO: 897182 - protein, 410 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGHAPQPFLYTEPVNYQAPRKFFSGSQHL

SEQ ID NO: 897183 - protein, 448 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQPGSMDLGVCSVNICSWGNNEGQTFSAQHPPGREGETRGQTSLEQVSTARELRCKILLPELTPRVLLPQLASWISDQKLPFLKILLCSPTSLGQSSLAGFTKLRWPYPLLQPHLLPHPYTTALHLC

SEQ ID NO: 897184 - protein, 266 aa, Homo sapiens [sequence omitted]

SEQ ID NO: 897185 - protein, 534 aa, Homo sapiens
MAHGSVTFRDVAIDFSQEEWEFLDPAQRDLYRDVMWENYSNFISLAGPSISKPDVITLLDEERKEPGMVVREGTRRYCPDLESRYRTNTLSPEKDIYEIYSFQWDIMERIKSYSLQGSIFRNDWECKSKIEGEKEQQEGYFGQVKITSEKMTTYKRHNFLTEYQIVHNGEKVYECKECRKTFIRRSTLSQHLRIHTGEKPYKCKECGQAFRQRAHLIRHHKLHTGEKPYECKECGKAFTVLQELTQHQRLHTGEKPYECKECGKAFRVHQQLARHQRIHTGEKPYECKDCGKTFRQCTHLTRHQRLHTAEKLYECKECGKAFVCGPDLRVHQKIHFGEKPYECKECGKAFRICQQLTVHQSIHTGEKPYECKECGKTFRLRQQLVRHQRIHTREKPYECMECWKTFSSYSQLISHQSIHIGERPYECEECGKAFRLLSQLTQHQSIHTGEKPYECKECRKPFRLLSQLTQHQSIHTGEKPYECKECGKAFRLYSFLTQHQRIHTGEKPYKCKECKKAFRQHSHLTQHQKIHNGI

SEQ ID NO: 897186 - protein, 534 aa, Homo sapiens; identical to SEQ ID NO: 897185

SEQ ID NO: 897187 - protein, 206 aa, Homo sapiens
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 897188 - protein, 262 aa, Homo sapiens
TQFPATHLNPSVPIQSSVTEMPASISGLIQRAVAAGVCWNSKRINQLFSQANPLLTMLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 897189 - protein, 206 aa, Homo sapiens; identical to SEQ ID NO: 897187

SEQ ID NO: 897190 - protein, 188 aa, Homo sapiens
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDYKITVVTACKCKRYTRQHNESSHNFESMSPAKPVQHHRERKRASKSSKHSMS

SEQ ID NO: 897191 - protein, 952 aa, Homo sapiens
PKARVRARRVPLVLSPHTPMALPQPPPPAGARDPVTPEHWASGPPSQAQPLLRQEAKEEEEGEETGVQGAWGTGTAEQRRRGWGEAAESAAAEEGQAEVGGAAAAGSGSPAGGAGGGLGSWRPLLAWLQRRQPQCCPCAAPLSRSAAHCCHGGTKMAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 897192 - protein, 272 aa, Homo sapiens
PKARVRARRVPLVLSPHTPMALPQPPPPAGARDPVTPEHWASGPPSQAQPLLRQEAKEEEEGEETGVQGAWGTGTAEQRRRGWGEAAESAAAEEGQAEVGGAAAAGSGSPAGGAGGGLGSWRPLLAWLQRRQPQCCPCAAPLSRSAAHCCHGGTKMAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNK

SEQ ID NO: 897193 - protein, 258 aa, Homo sapiens
PKARVRARRVPLVLSPHTPMALPQPPPPAGARDPVTPEHWASGPPSQAQPLLRQEAKEEEEGEETGVQGAWGTGTAEQRRRGWGEAAESAAAEEGQAEVGGAAAAGSGSPAGGAGGGLGSWRPLLAWLQRRQPQCCPCAAPLSRSAAHCCHGGTKMAALAYNLGKREINHYFSVRSAKVLALVAVLLLAACHLASRRYRGNDSCEYLLSSGRFLGEKVWQPHSCMMHKYKISMKTFLLKTRLHQLKWIFCGILKLMVL

SEQ ID NO: 897194 - protein, 952 aa, Homo sapiens; identical to SEQ ID NO: 897191

SEQ ID NO: 897195 - protein, 290 aa, Homo sapiens [sequence omitted]

SEQ ID NO: 897196 - protein, 280 aa, Homo sapiens
PKARVRARRVPLVLSPHTPMALPQPPPPAGARDPVTPEHWASGPPSQAQPLLRQEAKEEEEGEETGVQGAWGTGTAEQRRRGWGEAAESAAAEEGQAEVGGAAAAGSGSPAGGAGGGLGSWRPLLAWLQRRQPQCCPCAAPLSRSAAHCCHGGTKMAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKVKLVYSLL

SEQ ID NO: 897197 - protein, 952 aa, Homo sapiens; identical to SEQ ID NO: 897191

SEQ ID NO: 897198 - protein, 900 aa, Homo sapiens
PKARVRARRVPLVLSPHTPMALPQPPPPAGARDPVTPEHWASGPPSQAQPLLRQEAKEEEEGEETGVQGAWGTGTAEQRRRGWGEAAESAAAEEGQAEVGGAAAAVVRFPGGRRRWRPGELAAAPRLAAAAAAPVLPLCGAPFPLRRALLSWRNQDGGSGLQPGQAGDQPSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 897199 - protein, 952 aa, Homo sapiens; identical to SEQ ID NO: 897191

SEQ ID NO: 897200 - protein, 627 aa, Homo sapiens
PKARVRARRVPLVLSPHTPMALPQPPPPAGARDPVTPEHWASGPPSQAQPLLRQEAKEEEEGEETGVQGAWGTGTAEQRRRGWGEAAESAAAEEGQAEVGGAAAAGSGSPAGGAGGGLGSWRPLLAWLQRRQPQCCPCAAPLSRSAAHCCHGGTKMAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTVSIWNLSSESIGSDVILMFL

SEQ ID NO: 897201 - protein, 393 aa, Homo sapiens
PSPTLPSPLSRDRSVAPTMMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897202 - protein, 393 aa, Homo sapiens; identical to SEQ ID NO: 897201

SEQ ID NO: 897203 - protein, 336 aa, Homo sapiens
MITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897204 - protein, 353 aa, Homo sapiens
MITEQPDSRRVNSSVGFSVLQHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897205 - protein, 410 aa, Homo sapiens
PSPTLPSPLSRDRSVAPTMMEDDGQPRTLYVGNLSRDVTEVLILQLFSQIGPCKSCKMITEQPDSRRVNSSVGFSVLQHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897206 - protein, 153 aa, Homo sapiens
PSPTLPSPLSRDRSVAPTMMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISIAHKNGQDLEG

SEQ ID NO: 897207 - protein, 249 aa, Homo sapiens
MITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQR

SEQ ID NO: 897208 - protein, 153 aa, Homo sapiens; identical to SEQ ID NO: 897206

SEQ ID NO: 897209 - protein, 153 aa, Homo sapiens; identical to SEQ ID NO: 897206

SEQ ID NO: 897210 - protein, 249 aa, Homo sapiens; identical to SEQ ID NO: 897207

SEQ ID NO: 897211 - protein, 153 aa, Homo sapiens; identical to SEQ ID NO: 897206

SEQ ID NO: 897212 - protein, 153 aa, Homo sapiens; identical to SEQ ID NO: 897206

SEQ ID NO: 897213 - protein, 142 aa, Homo sapiens
PSPTLPSPLSRDRSVAPTMMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKIS

SEQ ID NO: 897214 - protein, 393 aa, Homo sapiens; identical to SEQ ID NO: 897201

SEQ ID NO: 897215 - protein, 375 aa, Homo sapiens
LKKKERKKERKYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897216 - protein, 353 aa, Homo sapiens; identical to SEQ ID NO: 897204

SEQ ID NO: 897217 - protein, 153 aa, Homo sapiens; identical to SEQ ID NO: 897206

SEQ ID NO: 897218 - protein, 252 aa, Homo sapiens
MDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897219 - protein, 248 aa, Homo sapiens
EVTLQELYAVSGYGFVSLYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 897220 - protein, 233 aa, Homo sapiens
EVTLQELYAVSGYGFVSLYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQPQQYGQYMANGWQVPPYGVYGQPWNQQGFGVDQSPSAAWMGGFGAQPPQGQAPPPVIPPPNQAGYGMASYQTQ

SEQ ID NO: 897221 - protein, 153 aa, Homo sapiens; identical to SEQ ID NO: 897206

SEQ ID NO: 897222 - protein, 153 aa, Homo sapiens; identical to SEQ ID NO: 897206

SEQ ID NO: 897223 - protein, 102 aa, Homo sapiens
MITEQPDSRRVNSSVGFSVLQHTSNDPYCFVEFYEHRDAAAALAAMNGRKILGKEVKVNWATTPSSQKKDTSNHFHVFVGDLSPEITTEDIKSAFAPFGKIS

SEQ ID NO: 897224 - protein, 747 aa, Homo sapiens
MSKLKSSESVRVVVRCRPMNGKEKAASYDKVVDVDVKLGQVSVKNPKGTAHEMPKTFTFDAVYDWNAKQFELYDETFRPLVDSVLQGFNGTIFAYGQTGTGKTYTMEGIRGDPEKRGVIPNSFDHIFTHISRSQNQQYLVRASYLEIYQEEIRDLLSKDQTKRLELKERPDTGVYVKDLSSFVTKSVKEIEHVMNVGNQNRSVGATNMNEHSSRSHAIFVITIECSEVGLDGENHIRVGKLNLVDLAGSERQAKTGAQGERLKEATKINLSLSALGNVISALVDGKSTHIPYRDSKLTRLLQDSLGGNAKTVMVANVGPASYNVEETLTTLRYANRAKNIKNKPRVNEDPKDALLREFQEEIARLKAQLEKRSIGRRKRREKRREGGGSGGGGEEEEEEGEEGEEEGDDKDDYWREQQEKLEIEKRAIVEDHSLVAEEKMRLLKEKEKKMEDLRREKDAAEMLGAKIKAMESKLLVGGKNIVDHTNEQQKILEQKRQEIAEQKRREREIQQQMESRDEETLELKETYSSLQQEVDIKTKKLKKLFSKLQAVKAEIHDLQEEHIKERQELEQTQNELTRELKLKHLIIENFIPLEEKSKIMNRAFFDEEEDHWKLHPITRLENQQMMKRPVSAVGYKRPLSQHARMSMMIRPEARYRAENIVLLELDMPSRTTRDYEGPAIAPKVQAALDAALQDEDEIQVDASSFESTANKKSKARPKSGRKSGSSSSSSGTPASQLYPQSRGLVPK

SEQ ID NO: 897225 - protein, 747 aa, Homo sapiens; identical to SEQ ID NO: 897224

SEQ ID NO: 897226 - protein, 747 aa, Homo sapiens; identical to SEQ ID NO: 897224

SEQ ID NO: 897227 - protein, 747 aa, Homo sapiens; identical to SEQ ID NO: 897224

SEQ ID NO: 897228 - protein, 747 aa, Homo sapiens; identical to SEQ ID NO: 897224

SEQ ID NO: 897229 - protein, 747 aa, Homo sapiens; identical to SEQ ID NO: 897224

SEQ ID NO: 897230 - protein, 747 aa, Homo sapiens; identical to SEQ ID NO: 897224

SEQ ID NO: 897231 - protein, 747 aa, Homo sapiens; identical to SEQ ID NO: 897224

SEQ ID NO: 897232 - protein, 109 aa, Homo sapiens
YLEDPVYATPNRPPFTLQPKTHIAANGNSDSSRAKNLMGFSLHCAKFWAGLSTFGNRKAGVSIEDPLGLRAQSENPGMEEWHESTGHEFMSRPSCRQQLAKPESKSNRI

SEQ ID NO: 897233 - protein, 89 aa, Homo sapiens
EEGDDKDDYWREQQEKLEIEKRAIVEDHSLVAEEKMRLLKEKEKKMEDLRREKDAAEMLGAKIKVPYPYPSLGPCPVTAFAFIKQQQKT

SEQ ID NO: 897234 - protein, 156 aa, Homo sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 897235 - protein, 156 aa, Homo sapiens; identical to SEQ ID NO: 897234

SEQ ID NO: 897236 - protein, 156 aa, Homo sapiens; identical to SEQ ID NO: 897234

SEQ ID NO: 897237 - protein, 156 aa, Homo sapiens; identical to SEQ ID NO: 897234

SEQ ID NO: 897238 - protein, 176 aa, Homo sapiens
DRPLVRSGYGYTLFWESEATMALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 897239 - protein, 156 aa, Homo sapiens; identical to SEQ ID NO: 897234

SEQ ID NO: 897240 - protein, 156 aa, Homo sapiens; identical to SEQ ID NO: 897234

SEQ ID NO: 897241 - protein, 138 aa, Homo sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQVHITDCRLTNGSRYPNCAYRTSPKERHIIVACEGSPYVPVHFDASVEDST

SEQ ID NO: 897242 - protein, 138 aa, Homo sapiens; identical to SEQ ID NO: 897241

SEQ ID NO: 897243 - protein, 157 aa, Homo sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNSTSSSPQLPLPSSFPAVKEVTTVRAPIQHTHASLS

SEQ ID NO: 897244 - protein, 156 aa, Homo sapiens; identical to SEQ ID NO: 897234

SEQ ID NO: 897245 - protein, 156 aa, Homo sapiens; identical to SEQ ID NO: 897234

SEQ ID NO: 897246 - protein, 156 aa, Homo sapiens; identical to SEQ ID NO: 897234

SEQ ID NO: 897247 - protein, 173 aa, Homo sapiens
NSGASCSSRLFWESEATMALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 897248 - protein, 116 aa, Homo sapiens
MDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 897249 - protein, 178 aa, Homo sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDSTNLILSTAASSLFLPCCERSNYS

SEQ ID NO: 897250 - protein, 165 aa, Homo sapiens
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEPTHNQKPTHHPPPPNNPKTTPQERER

SEQ ID NO: 897251 - protein, 1411 aa, Homo sapiens
MLRRILQRTPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQTLTENLLKKEQDYTKLEEKHNEESVSKKNIQATLHQKDLDCQQLQSRLSASETSLHRIHVELSEKGEATQKLKEELSEVETKYQHLKAEFKQLQQQREEKEQHGLQLQSEINQLHSKLLETERQLGEAHGRLKEQRQLSSEKLMDKEQQVADLQLKLSRLEEQLKEKVTNSTELQHQLDKTKQQHQEQQALQQSTTAKLREAQNDLEQVLRQIGDKDQKIQNLEALLQKSKENISLLEKEREDLYAKIQAGEGETAVLNQLQEKNHTLQEQVTQLTEKLKNQSESHKQAQENLHDQVQEQKAHLRAAQDRVLSLETSVNELNSQLNESKEKVSQLDIQIKAKTELLLSAEAAKTAQRADLQNHLDTAQNALQDKQQELNKITTQLDQVTAKLQDKQEHCSQLESHLKEYKEKYLSLEQKTEELEGQIKKLEADSLEVKASKEQALQDLQQQRQLNTDLELRATELSKQLEMEKEIVSSTRLDLQKKSEALESIKQKLTKQEEEKQILKQDFETLSQETKIQHEELNNRIQTTVTELQKVKMEKEALMTELSTVKDKLSKVSDSLKNSKSEFEKENQKGKAAILDLEKTCKELKHQLQVQMENTLKEQKELKKSLEKEKEASHQLKLELNSMQEQLIQAQNTLKQNEKEEQQLQGNINELKQSSEQKKKQIEALQGELKIAVLQKTELENKLQQQLTQAAQELAAEKEKISVLQNNYEKSQETFKQLQSDFYGRESELLATRQDLKSVEEKLSLAQEDLISNRNQIGNQNKLIQELKTAKATLEQDSAKKEQQLQERCKALQDIQKEKSLKEKELVNEKSKLAEIEEIKCRQEKEITKLNEELKSHKLESIKEITNLKDAKQLLIQQKLELQGKADSLKAAVEQEKRNQQILKDQVKKEEEELKKEFIEKEAKLHSEIKEKEVGMKKHEENEAKLTMQITALNENLGTVKKEWQSSQRRVSELEKQTDDLRGEIAVLEATVQNNQDERRALLERCLKGEGEIEKLQTKVLELQRKLDNTTAAVQELGRENQSLQIKHTQALNRKWAEDNEVQNCMACGKGFSVTVRRHHCRQCGNIFCAECSAKNALTPSSKKPVRVCDACFNDLQG

SEQ ID NO: 897252 - protein, 1411 aa, Homo sapiens; identical to SEQ ID NO: 897251

SEQ ID NO: 897253 - protein, 1411 aa, Homo sapiens; identical to SEQ ID NO: 897251

SEQ ID NO: 897254 - protein, 1411 aa, Homo sapiens; identical to SEQ ID NO: 897251

SEQ ID NO: 897255 - protein, 1411 aa, Homo sapiens; identical to SEQ ID NO: 897251

SEQ ID NO: 897256 - protein, 1425 aa, Homo sapiens
MLRRILQRTPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQTLTENLLKKEQDYTKLEEKHNEESVSKKNIQATLHQKDLDCQQLQSRLSASETSLHRIHVELSEKGEATQKLKEELSEVETKYQHLKAEFKQLQQQREEKEQHGLQLQSEINQLHSKLLETERQLGEAHGRLKEQRQLSSEKLMDKEQQVADLQLKLSRLEEQLKEKVTNSTELQHQLDKTKQQHQEQQALQQSTTAKLREAQNDLEQVLRQIGDKDQKIQNLEALLQKSKENISLLEKEREDLYAKIQAGEGETAVLNQLQEKNHTLQEQVTQLTEKLKNQSESHKQAQENLHDQVQEQKAHLRAAQDRVLSLETSVNELNSQLNESKEKVSQLDIQIKAKTELLLSAEAAKTAQRADLQNHLDTAQNALQDKQQELNKITTQLDQVTAKLQDKQEHCSQLESHLKEYKEKYLSLEQKTEELEGQIKKLEADSLEVKASKEQALQDLQQQRQLNTDLELRATELSKQLEMEKEIVSSTRLDLQKKSEALESIKQKLTKQEEEKQILKQDFETLSQETKIQHEELNNRIQTTVTELQKVKMEKEALMTELSTVKDKLSKVSDSLKNSKSEFEKENQKGKAAILDLEKTCKELKHQLQVQMENTLKEQKELKKSLEKEKELLIESRLVFVDASHASHQLKLELNSMQEQLIQAQNTLKQNEKEEQQLQGNINELKQSSEQKKKQIEALQGELKIAVLQKTELENKLQQQLTQAAQELAAEKEKISVLQNNYEKSQETFKQLQSDFYGRESELLATRQDLKSVEEKLSLAQEDLISNRNQIGNQNKLIQELKTAKATLEQDSAKKEQQLQERCKALQDIQKEKSLKEKELVNEKSKLAEIEEIKCRQEKEITKLNEELKSHKLESIKEITNLKDAKQLLIQQKLELQGKADSLKAAVEQEKRNQQILKDQVKKEEEELKKEFIEKEAKLHSEIKEKEVGMKKHEENEAKLTMQITALNENLGTVKKEWQSSQRRVSELEKQTDDLRGEIAVLEATVQNNQDERRALLERCLKGEGEIEKLQTKVLELQRKLDNTTAAVQELGRENQSLQIKHTQALNRKWAEDNEVQNCMACGKGFSVTVRRHHCRQCGNIFCAECSAKNALTPSSKKPVRVCDACFNDLQG

SEQ ID NO: 897257 - protein, 82 aa, Homo sapiens
IGVCSKSSGSCRRVSPGEKAPTPMLLPGSSEPRIDLTSSVPYGRLSVVPHEWLLSDPLLGDYTGPEIFFFVLTLLYHVLFLR

SEQ ID NO: 897258 - protein, 1160 aa, Homo sapiens
MLRRILQRTPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQTLTENLLKKEQDYTKLEEKHNEESVSKKNIQATLHQKDLDCQQLQSRLSASETSLHRIHVELSEKGEATQKLKEELSEVETKYQHLKAEFKQLQQQREEKEQHGLQLQSEINQLHSKLLETERQLGEAHGRLKEQRQLSSEKLMDKEQQVADLQLKLSRLEEQLKEKVTNSTELQHQLDKTKQQHQEQQALQQSTTAKLREAQNDLEQVLRQIGDKDQKIQNLEALLQKSKENISLLEKEREDLYAKIQAGEGETAVLNQLQEKNHTLQEQVTQLTEKLKNQSESHKQAQENLHDQVQEQKAHLRAAQDRVLSLETSVNELNSQLNESKEKVSQLDIQIKAKTELLLSAEAAKTAQRADLQNHLDTAQNALQDKQQELNKITTQLDQVTAKLQDKQEHCSQLESHLKEYKEKYLSLEQKTEELEGQIKKLEADSLEVKASKEQALQDLQQQRQLNTDLELRATELSKQLEMEKEIVSSTRLDLQKKSEALESIKQKLTKQEEEKQILKQDFETLSQETKIQHEELNNRIQTTVTELQKVKMEKEALMTELSTVKDKLSKVSDSLKNSKSEFEKENQKGKAAILDLEKTCKELKHQLQVQMENTLKEQKELKKSLEKEKEASHQLKLELNSMQEQLIQAQNTLKQNEKEEQQLQGNINELKQSSEQKKKQIEALQGELKIAVLQKTELENKLQQQLTQAAQELAAEKEKISVLQNNYEKSQETFKQLQSDFYGRESELLATRQDLKSVEEKLSLAQEDLISNRNQIGNQNKLIQELKTAKATLEQDSAKKEQQLQERCKALQDIQKEKSLKEKELVNEKSKLAEIEEIKCRQEKEITKLNEELKSHKLESIKRYQS

SEQ ID NO: 897259 - protein, 1141 aa, Homo sapiens
MLRRILQRTPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQTLTENLLKKEQDYTKLEEKHNEESVSKKNIQATLHQKDLDCQQLQSRLSASETSLHRIHVELSEKGEATQKLKEELSEVETKYQHLKAEFKQLQQQREEKEQHGLQLQSEINQLHSKLLETERQLGEAHGRLKEQRQLSSEKLMDKEQQVADLQLKLSRLEEQLKEKVTNSTELQHQLDKTKQQHQEQQALQQSTTAKLREAQNDLEQVLRQIGDKDQKIQNLEALLQKSKENISLLEKEREDLYAKIQAGEGETAVLNQLQEKNHTLQEQVTQLTEKLKNQSESHKQAQENLHDQVQEQKAHLRAAQDRVLSLETSVNELNSQLNESKEKVSQLDIQIKAKTELLLSAEAAKTAQRADLQNHLDTAQNALQDKQQELNKITTQLDQVTAKLQDKQEHCSQLESHLKEYKEKYLSLEQKTEELEGQIKKLEADSLEVKASKEQALQDLQQQRQLNTDLELRATELSKQLEMEKEIVSSTRLDLQKKSEALESIKQKLTKQEEEKQILKQDFETLSQETKIQHEELNNRIQTTVTELQKVKMEKEALMTELSTVKDKLSKVSDSLKNSKSEFEKENQKGKAAILDLEKTCKELKHQLQVQMENTLKEQKELKKSLEKEKEASHQLKLELNSMQEQLIQAQNTLKQNEKEEQQLQGNINELKQSSEQKKKQIEALQGELKIAVLQKTELENKLQQQLTQAAQELAAEKEKISVLQNNYEKSQETFKQLQSDFYGRESELLATRQDLKSVEEKLSLAQEDLISNRNQIGNQNKLIQELKTAKATLEQDSAKKEQQLQERCKALQDIQKEKSLKEKELVNEKSKLAEIEEIKCRQERYQS

SEQ ID NO: 897260 - protein, 131 aa, Homo sapiens
MRREETKEKGKKEEEKRRRGERRQRDQQRDAARDEESNRAANRSKQREPRRRATPTQRRDHAETRKCDQTAGVGGKRSGIRQAIVQVRVMYRSRQKQRAAPTRDKEETPPEEEKQSKTEHKRAVNKLKNSK

SEQ ID NO: 897261 - protein, 70 aa, Homo sapiens
VRGEHKVKLLLFPVLQPQPSRPPRAWQVLSQGLSVASIPAGRLSSGKLLGPSLKLNPHLAPGQASWVAGT

SEQ ID NO: 897262 - protein, 397 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 897263 - protein, 397 aa, Homo sapiens; identical to SEQ ID NO: 897262

SEQ ID NO: 897264 - protein, 397 aa, Homo sapiens; identical to SEQ ID NO: 897262

SEQ ID NO: 897265 - protein, 397 aa, Homo sapiens; identical to SEQ ID NO: 897262

SEQ ID NO: 897266 - protein, 66 aa, Homo sapiens
STEPGIMRQTRNHVGTALEASEIPFGPLEYSQTSENLRPHLRSQTWAPSQRPQHTLLLPLACRPPH

SEQ ID NO: 897267 - protein, 273 aa, Homo sapiens [sequence omitted]

SEQ ID NO: 897268 - protein, 273 aa, Homo sapiens [sequence omitted]

SEQ ID NO: 897269 - protein, 273 aa, Homo sapiens [sequence omitted]

SEQ ID NO: 897270 - protein, 219 aa, Homo sapiens
RKRSNEEGEEDDTGKMRRRRRRKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDRGKPCVCHYGLSLAWYPCMLKYCHSRDRPTPYKCGIRSCQKSYSFDFYVPQRQLCLWDEDPYPG

SEQ ID NO: 897271 - protein, 273 aa, Homo sapiens [sequence omitted]

SEQ ID NO: 897272 - protein, 273 aa, Homo sapiens [sequence omitted]

SEQ ID NO: 897273 - protein, 273 aa, Homo sapiens [sequence omitted]

SEQ ID NO: 897274 - protein, 245 aa, Homo sapiens
MRLPGVPLARPALLLLLPLLAPLLGTGAPAELRVRVRLPDGQVTEESLQADSDADSISLELRKPDGTLVSFTADFKKLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDRGKPCVCHYGLSLAWYPCMLKYCHSRDRPTPYKCGIRSCQKSYSFDFYVPQRQLCLWDEDPYPG

SEQ ID NO: 897275 - protein, 97 aa, Homo sapiens
CLSPPDGVDSSVFEALPKASEQAELPRCRQVGDRGKPCVCHYGLSLAWYPCMLKYCHSRDRPTPYKCGIRSCQKSYSFDFYVPQRQLCLWDEDPYPG

SEQ ID NO: 897276 - protein, 417 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 897277 - protein, 417 aa, Homo sapiens; identical to SEQ ID NO: 897276

SEQ ID NO: 897278 - protein, 417 aa, Homo sapiens; identical to SEQ ID NO: 897276

SEQ ID NO: 897279 - protein, 417 aa, Homo sapiens; identical to SEQ ID NO: 897276

SEQ ID NO: 897280 - protein, 417 aa, Homo sapiens; identical to SEQ ID NO: 897276

SEQ ID NO: 897281 - protein, 417 aa, Homo sapiens; identical to SEQ ID NO: 897276

SEQ ID NO: 897282 - protein, 372 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEDSRFPKILENLRLQKRGTGGVDTAATGGVFDISNLDRLGKSEVELVQLVIDGVNYLIDCERRLERGQDIRIPTPVIHTKH

SEQ ID NO: 897283 - protein, 305 aa, Homo sapiens [sequence omitted]

SEQ ID NO: 897284 - protein, 417 aa, Homo sapiens; identical to SEQ ID NO: 897276

SEQ ID NO: 897285 - protein, 185 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKSQNWPKHPRTQSASSLHSSRATRGGTCCGGCTEWPEG

SEQ ID NO: 897286 - protein, 168 aa, Homo sapiens
MKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVREDYVGELGGRT

SEQ ID NO: 897287 - protein, 336 aa, Homo sapiens
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVREDYVGELGGRT

SEQ ID NO: 897288 - protein, 188 aa, Homo sapiens
MFPGFAMFPNERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVREDYVGELGGRT

SEQ ID NO: 897289 - protein, 168 aa, Homo sapiens; identical to SEQ ID NO: 897286

SEQ ID NO: 897290 - protein, 417 aa, Homo sapiens; identical to SEQ ID NO: 897276

SEQ ID NO: 897291 - protein, 214 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALIYASNQWVWSCRRAVHRLL

SEQ ID NO: 897292 - protein, 417 aa, Homo sapiens; identical to SEQ ID NO: 897276

SEQ ID NO: 897293 - protein, 178 aa, Homo sapiens
MARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 897294 - protein, 281 aa, Homo sapiens
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEPPHSPRRTSLLVPTVIS

SEQ ID NO: 897295 - protein, 376 aa, Homo sapiens
MVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 897296 - protein, 384 aa, Homo sapiens
MVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGIHIWKLARQRGLLLNPSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 897297 - protein, 97 aa, Homo sapiens
STSVGPLVRLKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 897298 - protein, 720 aa, Homo sapiens
RRAGPALAGRVADMAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897299 - protein, 682 aa, Homo sapiens
MTCPPTGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897300 - protein, 754 aa, Homo sapiens
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTSEADLGGPEGRGGPVLTPPSSTSFHLPPVFSVAEDTDAAHCVAGCGLPGLGAAECPVEVHGPGSREGAQVCRAGLTTLGPAHRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897301 - protein, 720 aa, Homo sapiens; identical to SEQ ID NO: 897298

SEQ ID NO: 897302 - protein, 684 aa, Homo sapiens
ADSDLRDGGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897303 - protein, 692 aa, Homo sapiens
AEGGPCSSGPRSGHGGLPAPAAALPPGRGGRLHVCFRFPLHANPRPVWPRGHPTCKEDAAASGQGALAAAVGDPDAAVGSAETGAGHGPGPGAAEPAGCTSGPGSPAAEPTAPPCHLLAALGRLPVSLPGGPGVPLFPVGLPAARDWLPGRAGGPAEASLPPQGGPPGQAGRGPAPRRPPLLAALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897304 - protein, 529 aa, Homo sapiens
MFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897305 - protein, 248 aa, Homo sapiens
DIWDHIKNPLGILKAAVGRFRMRRRVMSAGLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897306 - protein, 224 aa, Homo sapiens [sequence omitted]

SEQ ID NO: 897307 - protein, 311 aa, Homo sapiens
RRAGPALAGRVADMAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDHNEFRHDDDE

SEQ ID NO: 897308 - protein, 126 aa, Homo sapiens
PGAVGGWVGGGGGLCPSWEDFPREAAVWGGALGAICSPHRDSLLLETGFLAVLVAPLRPASHRKEAPQGRQAGALPHEDLPFWLVRWLLFRRRLGVCRTQFETPVLCDAKMLTFLPCLSALLFGGA

SEQ ID NO: 897309 - protein, 732 aa, Homo sapiens
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRYMAQEAGRGHRCAGPAGRPWVLAHRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897310 - protein, 743 aa, Homo sapiens
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPGAERAWGVWSGLGWSGVGRGGAGRVTVGATLMPLAAVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897311 - protein, 720 aa, Homo sapiens; identical to SEQ ID NO: 897298

SEQ ID NO: 897312 - protein, 720 aa, Homo sapiens; identical to SEQ ID NO: 897298

SEQ ID NO: 897313 - protein, 434 aa, Homo sapiens
LLAGRMPSGAYRPGICVSREAKQDMKTAATPWRRVRGPGARLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 897314 - protein, 524 aa, Homo sapiens
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFGNPWGQNNGIRAGG

SEQ ID NO: 897315 - protein, 79 aa, Homo sapiens
GGSASPDFLPSPAALTYHYETQCLPTPAAWFAHHLPVWLHKLSVVATFLIEIAVPPLFFAPIRRLRLAAFYSQVGEGRS

SEQ ID NO: 897316 - protein, 1187 aa, Homo sapiens
MADPAAPTPAAPAPAQAPAPAPEAVPAPAAAPVPAPAPASDSASGPSSDSGPEAGSQRLLFSHDLVSGRYRGSVHFGLVRLIHGEDSDSEGEEEGRGSSGCSEAGGAGHEEGRASPLRRGYVRVQWYPEGVKQHVKETKLKLEDRSVVPRDVVRHMRSTDSQCGTVIDVNIDCAVKLIGTNCIIYPVNSKDLQHIWPFMYGDYIAYDCWLGKVYDLKNQIILKLSNGARCSMNTEDGAKLYDVCPHVSDSGLFFDDSYGFYPGQVLIGPAKIFSSVQWLSGVKPVLSTKSKFRVVVEEVQVVELKVTWITKSFCPGGTDSVSPPPSVITQENLGRVKRLGCFDHAQRQLGERCLYVFPAKVEPAKIAWECPEKNCAQGEGSMAKKVKRLLKKQVVRIMSCSPDTQCSRDHSMEDPDKKGESKTKSEAESASPEETPDGSASPVEMQDEGAEEPHEAGEQLPPFLLKEGRDDRLHSAEQDADDEAADDTDDTSSVTSSASSTTSSQSGSGTSRKKSIPLSIKNLKRKHKRKKNKITRDFKPGDRVAVEVVTTMTSADVMWQDGSVECNIRSNDLFPVHHLDNNEFCPGDFVVDKRVQSCPDPAVYGVVQSGDHIGRTCMVKWFKLRPSGDDVELIGEEEDVSVYDIADHPDFRFRTTDIVIRIGNTEDGAPHKEDEPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPCESALAWSSPSPAFSGLLFVSPDLGAGWLVPSPDPSYCPRANHFPVVVTVLRPAAASGKSVGVLTCPARLADGAPGPLHEGLTILFPPLANHSFKKIEFQPPEAKKFFSTVRKEMALLATSLPEGIMVKTFEDRMASRLGMGRCRCAVWAPSPRGHQPWVPKPPGLTGTCEDTHPPTFYRGGHRLSQVRADSAVCPGQMVLSFLPPLKNYFLGRAQWLTPVIPALWEAEVGGSRGQEIETILANTVKPRLH

SEQ ID NO: 897317 - protein, 1292 aa, Homo sapiens [sequence omitted]

SEQ ID NO: 897318 - protein, 1292 aa, Homo sapiens [sequence omitted]

SEQ ID NO: 897319 - protein, 729 aa, Homo sapiens
IRLKILFSLSELIQTLEYLAVVLSDRSSTGILQSCPDPAVYGVVQSGDHIGRTCMVKWFKLRPSGDDVELIGEEEDVSVYDIADHPDFRFRTTDIVIRIGNTEDGAPHKEDEPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPSNHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQSLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 897320 - protein, 514 aa, Homo sapiens
MLYKCWGRMMVFELSAHTTSTLLLTPDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPSNHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQSLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 897321 - protein, 1381 aa, Homo sapiens
MADPAAPTPAAPAPAQAPAPAPEAVPAPAAAPVPAPAPASDSASGPSSDSGPEAGSQRLLFSHDLVSGRYRGSVHFGLVRLIHGEDSDSEGEEEGRGSSGCSEAGGAGHEEGRASPLRRGYVRVQWYPEGVKQHVKETKLKLEDRSVVPRDVVRHMRSTDSQCGTVIDVNIDCAVKLIGTNCIIYPVNSKDLQHIWPFMYGDYIAYDCWLGKVYDLKNQIILKLSNGARCSMNTEDGAKLYDVCPHVSDSGLFFDDSYGFYPGQVLIGPAKIFSSVQWLSGVKPVLSTKSKFRVVVEEVQVVELKVTWITKSFCPGGTDSVSPPPSVITQENLGRVKRLGCFDHAQRQLGERCLYVFPAKVEPAKIAWECPEKNCAQGEGSMAKKVKRLLKKQVVRIMSCSPDTQCSRDHSMEDPDKKGESKTKSEAESASPEETPDGSASPVEMQDEGAEEPHEAGEQLPPFLLKEGRDDRLHSAEQDADDEAADDTDDTSSVTSSASSTTSSQSGSGTSRKKSIPLSIKNLKRKHKRKKNKITRDFKPGDRVAVEVVTTMTSADVMWQDGSVECNIRSNDLFPVHHLDNNEFCPGDFVVDKRVQSCPDPAVYGVVQSGDHIGRTCMVKWFKLRPSGDDVELIGEEEDVSVYDIADHPDFRFRTTDIVIRIGNTEDGAPHKEDEPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPCESALAWSSPSPAFSGLLFVSPDLGAGWLVPSPDPSYCPRANHFPVVVTVLRPAAASGKSVGVLTCPARLADGAPGPLHEGLTILFPPLANHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQSLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 897322 - protein, 1292 aa, Homo sapiens [sequence omitted]

SEQ ID NO: 897323 - protein, 1292 aa, Homo sapiens [sequence omitted]

SEQ ID NO: 897324 - protein, 248 aa, Homo sapiens
CPVCVQGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQSLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 897325 - protein, 128 aa, Homo sapiens
MALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQSLASASRDHTDQTSETAPDASVPP

SEQ ID NO: 897326 - protein, 369 aa, Homo sapiens
MVWAPLGPPRTDCLTLLHTPSKDSPKMSLEWLVAWSWSLDGLRDCIATGIQSVRDCDTTAVITVACLLVLFVWYCYHVGREQPRPYVSVNSLMQAADANGLQNGYVYCQSPECVRCTHNEGLNQKLYHNLQEYAKRYSWSGMGRIHKGIREQGRYLNSRPSIQKPEVFFLPDLPTTPYFSRDAQKHDVEVLERNFQTILCEFETLYKAFSNCSLPQGWKMNSTPSGEWFTFYLVNQGVCVPRNCRKCPRTYRLLGSLRTCIGNNVFGNACISVLSPGTVITEHYGPTNIRIRCHLGLKTPNGCELVVGGEPQCWAEGRCLLFDDSFLHAAFHEGSAEDGPRVVFMVDLWHPNVAAAERQALDFIFAPGR

SEQ ID NO: 897327 - protein, 369 aa, Homo sapiens; identical to SEQ ID NO: 897326

SEQ ID NO: 897328 - protein, 369 aa, Homo sapiens; identical to SEQ ID NO: 897326

SEQ ID NO: 897329 - protein, 117 aa, Homo sapiens
MAHGWFSWWICGIQTSQRPNGRLLISSLLRDDESISHAGVGEKGRGGAWADCGPVQSLPVLFPCSETCLSGKLLFGILYHVGSLFPLVIVNGNFSACISLDFFFFLPIICFRDSFLA

SEQ ID NO: 897330 - protein, 211 aa, Homo sapiens
MTFRSMFPPHRTAVSEDESVFGECFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGNRSSLPFCGPHALGPKNKTNTRMLLVRGGDNWELEMFGLKEFLFL

SEQ ID NO: 897331 - protein, 478 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGPSWNRAPFRKGCGVCWTVWKGSASRVPFTMC

SEQ ID NO: 897332 - protein, 601 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEVLGSMWPCPDGVHRAACFSQHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 897333 - protein, 544 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKKWSLSSSKTKEGRKVDGERVLNPQPVSLSLFPGKPHSTAWGLLRLRYELFLSK

SEQ ID NO: 897334 - protein, 492 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGNRSSLPFCGPHALGPKNKTNTRMLLVRGGDNWELEMFGLKEFLFL

SEQ ID NO: 897335 - protein, 187 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAAKMEPFIFQDQRRKEGGR

SEQ ID NO: 897336 - protein, 176 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEVLFFLGSHSFHLCFL

SEQ ID NO: 897337 - protein, 581 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 897338 - protein, 356 aa, Homo sapiens
MHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 897339 - protein, 517 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMITLSLATRRTDSKGGLAHPMTLLFKDKVAHFSYPFTFEAFFLHEDESSDALPEWPVLYCEVLSLDFWQRYRVEGYGAVVLPATPGNRSSLPFCGPHALGPKNKTNTRMLLVRGGDNWELEMFGLKEFLFL

SEQ ID NO: 897340 - protein, 454 aa, Homo sapiens
RLRCQENRAARFPAQSRRVAAVMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPATMTWPWH

SEQ ID NO: 897341 - protein, 741 aa, Homo sapiens
AARGQSAPGVGLAVRPSEVVGWEEIRSHTRGGGLSCCRRRLCRRRECGVGTGAAAAATPGIFVASSRPFCPAAFPQSALPTPLRPGAPASISRSLSTTHTAPPIMDPGSGGGGGGGGGGGSSSGSSSSDSAPDCWDQADMEAPGPGPCGGGGSLAAAAEAQRENLSAAFSRQLNVNAKPFVPNVHAAEFVPSFLRCPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 897342 - protein, 198 aa, Homo sapiens
MELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKKNTYQHPTRKHGWGALGPRERFKNQSLVAARAPDVKYTLANVGRKEPAHCKGAGSPKKTAGTQPSDTPEGPRQAAKRARSENAR

SEQ ID NO: 897343 - protein, 741 aa, Homo sapiens; identical to SEQ ID NO: 897341

SEQ ID NO: 897344 - protein, 830 aa, Homo sapiens
AARGQSAPGVGLAVRPSEVVGWEEIRSHTRGGGLSCCRRRLCRRRECGVGTGAAAAATPGIFVASSRPFCPAAFPQSALPTPLRPGAPASISRSLSTTHTAPPIMDPGSGGGGGGGGGGGSSSGSSSSDSAPDCWDQADMEAPGPGPCGGGGSLAAAAEAQRENLSAAFSRQLNVNAKPFVPNVHAAEFVPSFLRCPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKDYSIFLMTLHNTVRKIDCRSLPGSRERLSIFLMTLHNTVRKIDCRSLLHTAFSYFLPIDKPLPIFCKEEIHSKSPHYVSFLILRALLCHC

SEQ ID NO: 897345 - protein, 741 aa, Homo sapiens; identical to SEQ ID NO: 897341

SEQ ID NO: 897346 - protein, 741 aa, Homo sapiens; identical to SEQ ID NO: 897341

SEQ ID NO: 897347 - protein, 463 aa, Homo sapiens
MQKYSENLCKIKTKRVGLSVYCLEIEVTNSKVLLSNKPMYFFFCELKIFEICDNRMSKVPKLYTVQVVHCNEVTHICWLHKLQVLLSQYGTLNCDVVQQLPASSQLIRCEYFGLDLQPDAVLQPKKKVEPMIKNCSQDEPGKKSAKLPWRSAGTLVMTGITPGSLMTITHNSTLAPFLTGMDFLMDCYFMDDSFIALGRGFKVVKGKIRSFITGLNIQATFNFKTLCEKCGYSTIALILGWLNVIFIGWLTLSNCAINPFTDIGKEENNQWIQGTIIYLQIIGFYFLQLTFSVILADAIWYILDLVSFVERSRHGSILLSKCNCTCTKDLTSFTFSSQLVRLGFIVNEYGIERIEKCFYFPVVIPWIPFDPVYYQFSSGRFGSTFGGFWLYDILDFNILELLSLPFNKYTSHIPLILCFLETIMLAELFTKDYYKGLKVWEWRLIKTFMFSNIREKQVGTTSD

SEQ ID NO: 897348 - protein, 741 aa, Homo sapiens; identical to SEQ ID NO: 897341

SEQ ID NO: 897349 - protein, 728 aa, Homo sapiens
AARGQSAPGVGLAVRPSEVVGWEEIRSHTRGGGLSCCRRRLCRRRECGVGTGAAAAATPGIFVASSRPFCPAAFPQSALPTPLRPGAPASISRSLSTTHTAPPIMDPGSGGGGGGGGGGGSSSGSSSSDSAPDCWDQADMEAPGPGPCGGGGSLAAAAEAQRENLSAAFSRQLNVNAKPFVPNVHAAEFVPSFLRCPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKSF

SEQ ID NO: 897350 - protein, 435 aa, Homo sapiens
AARGQSAPGVGLAVRPSEVVGWEEIRSHTRGGGLSCCRRRLCRRRECGVGTGAAAAATPGIFVASSRPFCPAAFPQSALPTPLRPGAPASISRSLSTTHTAPPIMDPGSGGGGGGGGGGGSSSGSSSSDSAPDCWDQADMEAPGPGPCGGGGSLAAAAEAQRENLSAAFSRQLNVNAKPFVPNVHAAEFVPSFLRCPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVRKTFPVHLYIC

SEQ ID NO: 897351 - protein, 202 aa, Homo sapiens
AARGQSAPGVGLAVRPSEVVGWEEIRSHTRGGGLSCCRRRLCRRRECGVGTGAAAAATPGIFVASSRPFCPAAFPQSAGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAWQSTHWRTNNVF

SEQ ID NO: 897352 - protein, 741 aa, Homo sapiens; identical to SEQ ID NO: 897341

SEQ ID NO: 897353 - protein, 627 aa, Homo sapiens
AARGQSAPGVGLAVRPSEVVGWEEIRSHTRGGGLSCCRRRLCRRRECGVGTGAAAAATPGIFVASSRPFCPAAFPQSALPTPLRPGAPASISRSLSTTHTAPPIMDPGSGGGGGGGGGGGSSSGSSSSDSAPDCWDQADMEAPGPGPCGGGGSLAAAAEAQRENLSAAFSRQLNVNAKPFVPNVHAAEFVPSFLRCPAAPPPPAGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEIPAELLKMFGID

SEQ ID NO: 897354 - protein, 201 aa, Homo sapiens
MRCLSLHCVPPRGSPLVPRSAVNPLKWTVDKTSCVTGPRFKRSLSPVLAELDRSARTTDLSVKTKDVWEIPRESLQLIKRLGNGQFGEVWMGTWNGNTKVAIKTLKPGTMSPESFLEEAQIMKKLKHDKLVQLYAVVSEEPIYIVRADRSARTNYEMLKEEHEVAVLGAPQNPAPPTSTVIHIRSETSVDHVVWSLFNTLF

SEQ ID NO: 897355 - protein, 537 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897356 - protein, 537 aa, Homo sapiens; identical to SEQ ID NO: 897355

SEQ ID NO: 897357 - protein, 537 aa, Homo sapiens; identical to SEQ ID NO: 897355

SEQ ID NO: 897358 - protein, 534 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897359 - protein, 311 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGMLRLNYSLISFPVWKIPNTKDGR

SEQ ID NO: 897360 - protein, 471 aa, Homo sapiens
ISPCVIISLLVNFVSAGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897361 - protein, 343 aa, Homo sapiens
MKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897362 - protein, 482 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897363 - protein, 147 aa, Homo sapiens
LKDRKCEKNALKETLKTKQLTIQRIPGLMWNHLARAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897364 - protein, 478 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGKSRASQTWA

SEQ ID NO: 897365 - protein, 378 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVGPAG

SEQ ID NO: 897366 - protein, 311 aa, Homo sapiens; identical to SEQ ID NO: 897359

SEQ ID NO: 897367 - protein, 277 aa, Homo sapiens [sequence omitted]

SEQ ID NO: 897368 - protein, 158 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEYVSFCFHLTT

SEQ ID NO: 897369 - protein, 537 aa, Homo sapiens; identical to SEQ ID NO: 897355

SEQ ID NO: 897370 - protein, 537 aa, Homo sapiens; identical to SEQ ID NO: 897355

SEQ ID NO: 897371 - protein, 537 aa, Homo sapiens; identical to SEQ ID NO: 897355

SEQ ID NO: 897372 - protein, 537 aa, Homo sapiens; identical to SEQ ID NO: 897355

SEQ ID NO: 897373 - protein, 519 aa, Homo sapiens
MGCVQCKDKEATGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897374 - protein, 232 aa, Homo sapiens
MSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 897375 - protein, 253 aa, Homo sapiens [sequence omitted]

SEQ ID NO: 897376 - protein, 85 aa, Homo sapiens
NIKEAIASLYPNTTTSGMNNREVLEQVERGYRMPCPQDCPISLHELMIHCWKKDPEERPTFEYLQSFLEDYFTATEPQYQPGENL

SEQ ID NO: 897377 - protein, 387 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGWATPLLSPAHSALRGCLGERNGSFLLATFLVSAWVKYSH

SEQ ID NO: 897378 - protein, 158 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEELWKMHCIDVM

SEQ ID NO: 897379 - protein, 158 aa, Homo sapiens; identical to SEQ ID NO: 897368

SEQ ID NO: 897380 - protein, 761 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 897381 - protein, 146 aa, Homo sapiens
MQGSAPSCFPYQSCTADSQEVFPEVWALGVCTRRGTRQQLRPHGSATTRMVIRRVATTSSIRLATTSSTRIYLKKFGLSACAATTSSIQTSGLPGVWTLGVCMHTPSIHNRRIIAVDEVVAAHAESPNPLVTHVRMDEVVRQQIRT

SEQ ID NO: 897382 - protein, 761 aa, Homo sapiens; identical to SEQ ID NO: 897380

SEQ ID NO: 897383 - protein, 370 aa, Homo sapiens
MKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 897384 - protein, 224 aa, Homo sapiens [sequence omitted]

SEQ ID NO: 897385 - protein, 136 aa, Homo sapiens
MALPALGLDPWSLLGLFLFQLLQLLLPTTTAGGGGQGPMPRVRYYAGKCPTAGSVGIAIESWRWVEEGERNRGGEEMDMEKQGHRERCQGETEDLGERETQPETEVQKERKATGEQIEENRWPRGQGHASSSSPCW

SEQ ID NO: 897386 - protein, 402 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSVSTTPHTEHSLHIHNVHEKTPIMA

SEQ ID NO: 897387 - protein, 328 aa, Homo sapiens [sequence omitted]

SEQ ID NO: 897388 - protein, 761 aa, Homo sapiens; identical to SEQ ID NO: 897380

SEQ ID NO: 897389 - protein, 739 aa, Homo sapiens
MIPWPASDRKKSECAFKKKSNETQCFNFIRVLVSYNVTHLYTCGTFAFSPACTFIVSSLVPSAQAPKHPFSHLPTTFLCSSGKLWPSRCRTLMNFLAPDQFPSMSLSLPSSSPSFPRCETLAFWPPSLSPHLELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 897390 - protein, 957 aa, Homo sapiens
DTQRSLPELVRLEEGTWEALELPGDSLWLSMALPALGLDPWSLLGLFLFQLLQLLLPTTTAGGGGQGPMPRVRYYAGKCPTAGSVGIAIESWRWVEEGERNRGGEEMDMEKQGHRERCQGETEDLEKERHSQKQKSKRKEKPLESRLRKTGGHGARGTLLPVLHVGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIVSSLVPSAQAPKHPFSHLPTTFLCSSGKLWPSRCRTLMNFLAPDQFPSMSLSLPSSSPSFPRCETLAFWPPSLSPHLELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 897391 - protein, 761 aa, Homo sapiens; identical to SEQ ID NO: 897380

SEQ ID NO: 897392 - protein, 248 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFAHHNPTPRSVYVQIT

SEQ ID NO: 897393 - protein, 285 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDAIVRMIESRQKRKKKAYAFNGCKHTFRSPIYPDVALRGWEPTEKSPSVEGLLGTAASPPRVGKGPHGARLWGSSVTYPQPVVLKPKGRAPALV

SEQ ID NO: 897394 - protein, 281 aa, Homo sapiens
SGVSTPPSRRRSSSIRSPGPGAGQTPTSAPDSPGGHMTEAAGSREGHHVTTRRRRLRTQEPALTFQRQAKGAEERAFKNCAIVDFFTESSTLLEEGNLSPKTEDTYLPHILSPAVFGGPGTNFKMPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCKSTCFALVRLFEIRELT

SEQ ID NO: 897395 - protein, 247 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDAIVRMIESRQKRKKKAYCPQIGCSHTDIRKSDLIQDEALRRAIENHNKKRHRHSE

SEQ ID NO: 897396 - protein, 247 aa, Homo sapiens; identical to SEQ ID NO: 897395

SEQ ID NO: 897397 - protein, 247 aa, Homo sapiens; identical to SEQ ID NO: 897395

SEQ ID NO: 897398 - protein, 285 aa, Homo sapiens; identical to SEQ ID NO: 897393

SEQ ID NO: 897399 - protein, 157 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCKSTCFALVRLFEIRELT

SEQ ID NO: 897400 - protein, 264 aa, Homo sapiens
RLGTSRVAGKEVGLGRGNWGATRRRQLGLPESSTLLEEGNLSPKTEDTYLPHILSPAVFGGPGTNFKMPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCKSHACVWSAFELGTDDDSPVLIIKCYLLVNPSRGKGGTVWHWAQRLWKQSQGKPRVW

SEQ ID NO: 897401 - protein, 247 aa, Homo sapiens; identical to SEQ ID NO: 897395

SEQ ID NO: 897402 - protein, 247 aa, Homo sapiens; identical to SEQ ID NO: 897395

SEQ ID NO: 897403 - protein, 247 aa, Homo sapiens; identical to SEQ ID NO: 897395

SEQ ID NO: 897404 - protein, 135 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVPWGSTDPRGAETLSGREGLAFFLSRRLALPTRAPASLLFFCAVNQK

SEQ ID NO: 897405 - protein, 302 aa, Homo sapiens
MKAPGRLVLIILCSVVFSAVYILLCCWAGLPLCLATCLDHHFPTGSRPTVPGPLHFSGYSSVPDGKPLVREPCRSCAVVSSSGQMLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSRWAKKRPIVFAHPSWRTE

SEQ ID NO: 897406 - protein, 302 aa, Homo sapiens; identical to SEQ ID NO: 897405

SEQ ID NO: 897407 - protein, 302 aa, Homo sapiens; identical to SEQ ID NO: 897405

SEQ ID NO: 897408 - protein, 302 aa, Homo sapiens; identical to SEQ ID NO: 897405

SEQ ID NO: 897409 - protein, 216 aa, Homo sapiens
MKAPGRLVLIILCSVVFSAVYILLCCWAGLPLCLATCLDHHFPTGSRPTVPGPLHFSGYSSVPDGKPLVREPCRSCAVVSSSGQMLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRLVMRLREVHEQM

SEQ ID NO: 897410 - protein, 218 aa, Homo sapiens
MLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSRWAKKRPIVFAHPSWRTE

SEQ ID NO: 897411 - protein, 159 aa, Homo sapiens
MAFGGSPHLQVCQVAFVPGADGPQLTSIMTLCQSWSSLPSRPYHLLVPHFSGWPPWLGQPRAWGSLVKGPWSCDCRGRIRNVRVNVCFLEKKKHTKHNTVGAAQPPGKVSRPLVWGAPHTSKYPAKRSHRPRQQRGLTKTRGRGSPPRSARLKAAQTPG

SEQ ID NO: 897412 - protein, 138 aa, Homo sapiens
ASISGPESSSLQEAEQDSNPGSRDLLLPYVSWPPQGSGVGLHEPMGLARGGQGRRQGVAGGEWGSVPPQPCSPPRREKSHPSVPYHYFEKGRLDECQMYLAHEQAPRSAHRFITEKAVFSRWAKKRPIVFAHPSWRTE

SEQ ID NO: 897413 - protein, 112 aa, Homo sapiens
MKAPVSGKKEDFQGTQRPRLAEQLSSLSTPGPTATSDLPTAEQRRAEWPQSPTLFLQTVWPQAGGIHSAVSVPCYPCKTEVTLRAHQAKPTWNWGCEVQFSRSCLYCRSPGL

SEQ ID NO: 897414 - protein, 302 aa, Homo sapiens; identical to SEQ ID NO: 897405

SEQ ID NO: 897415 - protein, 302 aa, Homo sapiens; identical to SEQ ID NO: 897405

SEQ ID NO: 897416 - protein, 302 aa, Homo sapiens; identical to SEQ ID NO: 897405

SEQ ID NO: 897417 - protein, 266 aa, Homo sapiens [sequence omitted]

SEQ ID NO: 897418 - protein, 177 aa, Homo sapiens
MLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCRGKKHPSMLTLIEKAGNRCNVP

SEQ ID NO: 897419 - protein, 90 aa, Homo sapiens
PTATRSSRTRRARTGEPGACLLGSLWQLGPSFSGSLLSIRGCSVRPGRSALMEADMVLPSNGGQEAEGMSLRKLSHRSRIPDGVEGCQAF

SEQ ID NO: 897420 - protein, 1375 aa, Homo sapiens [sequence omitted]

SEQ ID NO: 897421 - protein, 1353 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPVNPCYDGSHMCDTTARCHPGTGVDYTCECASGYQGDGRNCVDENECATGFHRCGPNSVCINLPGSYRCECRSGYEFADDRHTCILITPPANPCEEAVIPVLLLGRPGVFTMEAARSAVPACLVMPAMGTSALFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 897422 - protein, 1402 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEGRISPPDSDLSSPLHPTPTYWPFYPETESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPVNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 897423 - protein, 1375 aa, Homo sapiens [sequence omitted]

SEQ ID NO: 897424 - protein, 1382 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPVNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGGSSTVFKEA

SEQ ID NO: 897425 - protein, 868 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPVNPCYDGSHMCDTTARCHPGTGVDYTCECASGYQGDGRNCVDENECATGFHRCGPNSVCINLPGSYRCECRSGYEFADDRHTCICEFQNHFPVWPKWCSLILLFNLSVF

SEQ ID NO: 897426 - protein, 1327 aa, Homo sapiens [sequence omitted]

SEQ ID NO: 897427 - protein, 974 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYRGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPVNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 897428 - protein, 154 aa, Homo sapiens
MLPTTGYMAILLQSGFLTYSNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 897429 - protein, 80 aa, Homo sapiens
TSHGRGRVLYREDTSPAVLGLAARYVRAGFPRSARFTPTHAFLATWEQVGAYEEVKRGALPSGEVSDQGYLTAEEIEGWA

SEQ ID NO: 897430 - protein, 847 aa, Homo sapiens
MSFSEMNRRTLAFRGGGLVTASGGGSTNNNAGGEASAWPPQPQPRQPPPTAPPALQPPNGRGADEEVELEGLEPQDLEASAGPAAGAAEEAKELLLPQDAGGPTSLGGGAGGPLLAERNRRTLAFRGGGGGGLGNNGSSRGRPETSVWPLRHFNGRGPATVDLELDALEGKELMQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAPESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 897431 - protein, 847 aa, Homo sapiens; identical to SEQ ID NO: 897430

SEQ ID NO: 897432 - protein, 847 aa, Homo sapiens; identical to SEQ ID NO: 897430

SEQ ID NO: 897433 - protein, 847 aa, Homo sapiens; identical to SEQ ID NO: 897430

SEQ ID NO: 897434 - protein, 229 aa, Homo sapiens
HSPASHRKITHPSTPAEETYNLGRQVLPLSAVTYFQKSGPGLLPAPATQSASVAGTLQNSLCSQVTKKKRANMLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 897435 - protein, 66 aa, Homo sapiens
SFPSLAVVVHFEMFALKRSFAIRVRLHNNLEIQSVQPMAAQVMSVLTPGGHFGTATHYSEHAFCTD

SEQ ID NO: 897436 - protein, 229 aa, Homo sapiens; identical to SEQ ID NO: 897434

SEQ ID NO: 897437 - protein, 73 aa, Homo sapiens
RSPPDVPTWSDHLLGTLPIPLHRWEGDLFTMENLGDGQSPVETSHTAVPHGDLMPWSLLGLLLKAKAALLEFL

SEQ ID NO: 897438 - protein, 229 aa, Homo sapiens; identical to SEQ ID NO: 897434

SEQ ID NO: 897439 - protein, 233 aa, Homo sapiens
HSPASHRKITHPSTPAEETYNLGRQVLPLSAVTYFQKSGPGLLPAPATQSASVAGTLQNSLCSQVTKKKRANMLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCCEYLMGRLQFTLLSPSYHGCFWQLEQISTWFSETSLCNFLLWLFVLLWRTLDCCLG

SEQ ID NO: 897440 - protein, 229 aa, Homo sapiens
KHGEKKPPITHPSTPAEETYNLGRQVLPLSAVTYFQKSGPGLLPAPATQSASVAGTLQNSLCSQVTKKKRANMLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 897441 - protein, 229 aa, Homo sapiens; identical to SEQ ID NO: 897434

SEQ ID NO: 897442 - protein, 229 aa, Homo sapiens; identical to SEQ ID NO: 897434

SEQ ID NO: 897443 - protein, 134 aa, Homo sapiens
HSPASHRKITHPSTPAEETYNLGRQVLPLSAVTYFQKSGPGLLPAPATQSASVAGTLQNSLCSQVTKKKRANMLVLLAGIFVVHIATVIMLFVSTIANVWLVSNTVDASVGLWKNCTNISCSDSLSYASEAVGR

SEQ ID NO: 897444 - protein, 104 aa, Homo sapiens
VWLVSNTVDASVGLWKNCTNISCSDSLSYASEGIYKDIDPVLTIGVVRECSAPGVTSCPCSPRPVSTDALKTVQAFMILSIIFCVIALLVFVFQLFTMEKGNRF

SEQ ID NO: 897445 - protein, 465 aa, Homo sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 897446 - protein, 465 aa, Homo sapiens; identical to SEQ ID NO: 897445

SEQ ID NO: 897447 - protein, 74 aa, Homo sapiens
ISSCLADWRWLHRVSPSRMISRVAVRRGEGCSCEVALGAAVEAPLTVWETIYAKLFPISHIYLIWLAASASSFV

SEQ ID NO: 897448 - protein, 157 aa, Homo sapiens
SPPRVGYKTRSSFCVPPPDCLRGGPPLPPLFCARPPIVIPPWGSVLLSPGVFPHVPPRCGCNTLFLPRVPFFVPPGRLFFGAPLYRHPFSPQNARARVRALCRRFPRGRYLRSPPRALRARARGGGASARAGPPPLFFFFFFFFFFLVFIFVVRVDL

SEQ ID NO: 897449 - protein, 181 aa, Homo sapiens
AGSRDDRGVGGRGEALDGGGSGAPPSVSQTESRAGTMSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNR

SEQ ID NO: 897450 - protein, 294 aa, Homo sapiens
AGSRDDRGVGGRGEALDGGGSGAPPSVSQTESRAGTMSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 897451 - protein, 165 aa, Homo sapiens
MVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 897452 - protein, 294 aa, Homo sapiens; identical to SEQ ID NO: 897450

SEQ ID NO: 897453 - protein, 122 aa, Homo sapiens
RGQYFPLQSAAYKQLVSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 897454 - protein, 44 aa, Homo sapiens
WLPWGRVTESYNATASRFPQELARQRGVLERTEKMVDKMDQDLK

SEQ ID NO: 897455 - protein, 294 aa, Homo sapiens; identical to SEQ ID NO: 897450

SEQ ID NO: 897456 - protein, 162 aa, Homo sapiens
AVVFLLESPYITGHVRLSTAVGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 897457 - protein, 294 aa, Homo sapiens; identical to SEQ ID NO: 897450

SEQ ID NO: 897458 - protein, 260 aa, Homo sapiens
AGSRDDRGVGGRGEALDGGGSGAPPSVSQTESRAGTMSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDLKISQKHINSIKGVFGG

SEQ ID NO: 897459 - protein, 342 aa, Homo sapiens
EFAAASTASVATADETERLKRAGVRGLLFHQLHGDDMASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGE

SEQ ID NO: 897460 - protein, 906 aa, Homo sapiens
EFAAASTASVATADETERLKRAGVRGLLFHQLHGDDMASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 897461 - protein, 870 aa, Homo sapiens
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 897462 - protein, 744 aa, Homo sapiens
MIVGEGLGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 897463 - protein, 906 aa, Homo sapiens; identical to SEQ ID NO: 897460

SEQ ID NO: 897464 - protein, 335 aa, Homo sapiens
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPG

SEQ ID NO: 897465 - protein, 371 aa, Homo sapiens
EFAAASTASVATADETERLKRAGVRGLLFHQLHGDDMASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPG

SEQ ID NO: 897466 - protein, 759 aa, Homo sapiens
EFAAASTASVATADETERLKRAGVRGLLFHQLHGDDMASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIIPSTRFQGFKERSCFRKR

SEQ ID NO: 897467 - protein, 88 aa, Homo sapiens
MLLGCMSSKSLMGSAETKPHFEDPASNHQGPEGGASPSPFSSRVSRMIQEPALPPGWEMKYTSEGVRYFVDHNTRTTTFKDPRPGFES

SEQ ID NO: 897468 - protein, 870 aa, Homo sapiens; identical to SEQ ID NO: 897461

SEQ ID NO: 897469 - protein, 747 aa, Homo sapiens
IGLLCETGLYGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 897470 - protein, 431 aa, Homo sapiens
MIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 897471 - protein, 930 aa, Homo sapiens
EFAAASTASVATADETERLKRAGVRGLLFHQLHGDDMASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQGCRRGRRPPGLVRRGDWPLGVAVRD

SEQ ID NO: 897472 - protein, 758 aa, Homo sapiens
EFAAASTASVATADETERLKRAGVRGLLFHQLHGDDMASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLTGVHVCSCVCVRTCI

SEQ ID NO: 897473 - protein, 759 aa, Homo sapiens; identical to SEQ ID NO: 897466

SEQ ID NO: 897474 - protein, 103 aa, Homo sapiens
FSLKLTQGMSHCAWPANAFCAEYTSFRHCQVLFCLSSNSPLEYRGMMTTSPARPDSSWSHPAPTPGQLTTAGSSSRLTRGPRGPGISLGPGCGFYKTVSFMTS

SEQ ID NO: 897475 - protein, 573 aa, Homo sapiens
CPGSIVQGVCGCCYTCASQRNESCGGTFGIYGTCDRGLRCVIRPPLNGDSLTEYEAGVCEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECPRPKKCRPIICDKYCPLGLLKNKHGCDICRCKKCPELSCSKICPLGFQQDSHGCLICKCREALLQLGHHPVGHLSHRGMVIIIKMRRAGHDGSPGNGSGLNGRETVFALINWPGAEPGRNHPYTCDVIATRQSTRGANPVNLTWTPEEP

SEQ ID NO: 897476 - protein, 107 aa, Homo sapiens
PGEHRAGRLRLLLHVRQPEERELRRHLRDLRNLRPGAALCHPPPAQWRLPHRVRSGRLRSCGVLNLRLLSALLLISKRNKWSPKWSRCDSRERSATIHSEVPGPYSG

SEQ ID NO: 897477 - protein, 202 aa, Homo sapiens
CPGSIVQGVCGCCYTCASQRNESCGGTFGIYGTCDRGLRCVIRPPLNGDSLTEYEAGVCEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTSC

SEQ ID NO: 897478 - protein, 309 aa, Homo sapiens
MPRHCSAAGCCTRDTRETRNRGISFHRLPKKDNPRRGLWLANCQRLDPSGQGLWDPASEYIYFCSKHFEEDCFELVGISGYHRLKEGAVPTIFESFSKLRRTTKTKGHSYPPGPPEVSRLRRCRKRCSEGRGPTTPFSPPPPADVTCFPVEEASAPATLPASPAGRLEPGLSSPFSDLLGPLGAQADEAGCSAQPSPERQPSPLEPRPVSPSAYMLRLPPPAGAYIQNEHSYQVGSALLWKRRAEAALDALDKAQRQLQACKRREQRLRLRLTKLQQERAREKRAQADARQTLKEHVQDFAMQLSSSMA

SEQ ID NO: 897479 - protein, 309 aa, Homo sapiens; identical to SEQ ID NO: 897478

SEQ ID NO: 897480 - protein, 106 aa, Homo sapiens
MPRHCSAAGCCTRDTRETRNRGISFHRLPKKDNPRRGLWLANCQRLDPSGQGLWDPASEYIYFCSKHFEEDCFELVGIRWASLPADAGVGCGAPGGLGQLQVMEVP

SEQ ID NO: 897481 - protein, 126 aa, Homo sapiens
MSPAFLWKRPQHLPLCRPPQLGGWSLALAAPFQTYWAPWVPRQMKQAAAPSLHQSGSPPLSNHGQSPPQRICCACPHPPEPTSRMNTATRWAAPYSGSGEPRQPLMPLTRPSASCRPASGGSSGCG

SEQ ID NO: 897482 - protein, 126 aa, Homo sapiens; identical to SEQ ID NO: 897481

SEQ ID NO: 897483 - protein, 126 aa, Homo sapiens; identical to SEQ ID NO: 897481

SEQ ID NO: 897484 - protein, 126 aa, Homo sapiens; identical to SEQ ID NO: 897481

SEQ ID NO: 897485 - protein, 171 aa, Homo sapiens
RQLPAREDGKVAGAEASSTGKQVTQQVELEPGLSSPFSDLLGPLGAQADEAGCSAQPSPERQPSPLEPRPVSPSAYMLRLPPPAGAYIQNEHSYQVGSALLWKRRAEAALDALDKAQRQLQACKRREQRLRLRLTKLQQERAREKRAQADARQTLKEHVQDFAMQLSSSMA

SEQ ID NO: 897486 - protein, 948 aa, Homo sapiens
YGESIVANSEICLSRSTGSQCSLGPGGRYGIIGRVHAKYSGGPLYAQSLNIGRESQERRTVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 897487 - protein, 921 aa, Homo sapiens
PTADPARGQPGGGRAGAAAQGLAAAMTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 897488 - protein, 853 aa, Homo sapiens
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDWESPSLTLSPRHTHISLATLKRALAAM

SEQ ID NO: 897489 - protein, 603 aa, Homo sapiens [sequence omitted]

SEQ ID NO: 897490 - protein, 896 aa, Homo sapiens
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 897491 - protein, 986 aa, Homo sapiens
MPRATWANSKERSWAESERGPRDTGNGGSKAERHIQEIETGRGGDRAKAHRRQRMRLRGTERASLGPGRRLGDSRGTDMPGARAQGLAAAMTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 897492 - protein, 712 aa, Homo sapiens
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGQPTCHPGVATLLMGSEPVERAQPRVEGAGQNGHCDEPKGLEWRESWISRPTRMAQLALKEDPPPGKEESHKAQSKGQPPG

SEQ ID NO: 897493 - protein, 304 aa, Homo sapiens
MVRGWVAHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 897494 - protein, 444 aa, Homo sapiens
VLIYLSPALDAQESMGSVNLSLIFIIALGSIAGILFVTMIFVAIKCKRDNKEIRTYNCRIAEYSYGHQKKSSKKKKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 897495 - protein, 491 aa, Homo sapiens
VLIYLSPALDAQESMGSVNLSLIFIIALGSIAGILFVTMIFVAIKCKRDNKEIRTYNCSNCLTITCLLGCFIKGQNSKCLHCISVSPISEEQDKKTEEKVSLRGKRIAEYSYGASKEIKQEEKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 897496 - protein, 491 aa, Homo sapiens; identical to SEQ ID NO: 897495

SEQ ID NO: 897497 - protein, 164 aa, Homo sapiens
MASPHQEPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 897498 - protein, 156 aa, Homo sapiens
MASPHQEPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVRTSLDNPSPSAWGWTHGAVQPGDHCE

SEQ ID NO: 897499 - protein, 164 aa, Homo sapiens; identical to SEQ ID NO: 897497

SEQ ID NO: 897500 - protein, 164 aa, Homo sapiens; identical to SEQ ID NO: 897497

SEQ ID NO: 897501 - protein, 215 aa, Homo sapiens
GCKWVSLTAVPTSDKPTICKTRIQVPSSPYNFATSMSLPHSREAHPLCLLLWDGNSLILFVIGKPLRGVLGVQLGVLPGKPQQHPSLQVHPKLGAQASSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 897502 - protein, 160 aa, Homo sapiens
MKNTDKNKTKHRHTHRKNTKTAQDKKNQKQHEHGTERTHPRRKTKDRTTQPGSGARHTSSGGEGGRGPAGAEPTGVNSSRGAAHETGEGRGAAEEGGGTETRHGTREAKSKRAGGGKPRARGDRTATRRRSDARQRTAHPPPKETEHERRRRETAQTTKG

SEQ ID NO: 897503 - protein, 100 aa, Homo sapiens
MSTGPTAATGSNRRLQQTQNQVDEVVDIMRVNVDKVLERDQKLSELDDRADALQAGASQFETSAAKLKRKYWWKNCEMWAIGITVLVIFIIIIIVWVVSS

SEQ ID NO: 897504 - protein, 160 aa, Homo sapiens; identical to SEQ ID NO: 897502

SEQ ID NO: 897505 - protein, 160 aa, Homo sapiens; identical to SEQ ID NO: 897502

SEQ ID NO: 897506 - protein, 340 aa, Homo sapiens
MQRKKKREEDDQQKTTKQTYTRTTTTSDQTDNRRGRYQEKDQEKNDQKNEENRQAQKTTRTVEDKHTTDTNKRREKGSRGGSTATENRTKERAKQRKGAARQRQHTRQRTTAPGDRRGERAREREGRTKTRNQREQRRDSRQDERQKKAQSIEQTKMQSSKRVRGRSGLSARARSHARRGHGTEPKQERGQRGPRRGDRSGDGTNTTEQARGRRGESSRVRQRRQRDRRRSRQKHRDRGNGGEQEQRENGSGKKRDETGQTSTKKDRNMHTRRGERHGKATKATKQGKDGGRNSEPPTRKERAERRDDETARDTHTRGASGSQQADEENETQRRAEHAST

SEQ ID NO: 897507 - protein, 160 aa, Homo sapiens; identical to SEQ ID NO: 897502

SEQ ID NO: 897508 - protein, 100 aa, Homo sapiens; identical to SEQ ID NO: 897503

SEQ ID NO: 897509 - protein, 100 aa, Homo sapiens; identical to SEQ ID NO: 897503

SEQ ID NO: 897510 - protein, 215 aa, Homo sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 897511 - protein, 215 aa, Homo sapiens; identical to SEQ ID NO: 897510

SEQ ID NO: 897512 - protein, 215 aa, Homo sapiens; identical to SEQ ID NO: 897510

SEQ ID NO: 897513 - protein, 116 aa, Homo sapiens
IILGLGICKLNWRFFFIKIYIVPALSLLPILNPLPVCPSLTTMIVYILISCEATAKGGRNGHFLVVVNALLDSFIQSIVEKFSHNPVLASEPEMPSLGPGPKIKQTRGTCSVYTGK

SEQ ID NO: 897514 - protein, 128 aa, Homo sapiens
MMTAVSLTTRPQESVAFEDVAVYFTTKEWAIMVPAERALYRDVMLENYEAVAFVVPPTSKPALVSHLEQGKESCFTQPQGVLSRNDWRAGWIGYLELRRYTYLAKAVLRRIVSKIFRNRQCWEDRRKA

SEQ ID NO: 897515 - protein, 97 aa, Homo sapiens
PFSPRAAEASTANAVSRAPPPADASRAGKGCGLSPKAPVSPMFNLYMHQNDSEALVRAALVANGDLACHSGSRACPVRRDDCGLHPFRSQGGCRPGP

SEQ ID NO: 897516 - protein, 170 aa, Homo sapiens
TDTVCVCVCVCVCVCVCVLPPSCANWIWAIIDNDYSPQNHHDTINPAPDVQQISPLLDIKVPQWLTDNRLLKYQVLLEIPQVTVEWCSTLIPASLLPLPGEDDSTHSCCEILNQIYARWEDLKDQPLDNLVKIWFSDGSSFVQNETIYAGYTEAKALSLGTSGQLAKLIF

SEQ ID NO: 897517 - protein, 74 aa, Homo sapiens
LMDLSLHSSLSPKAPVSPMFNLYMHQNDSEALVRAALVANGDLACHSGSRACPVRRDDCGLHPFRSQGGCRPGP

SEQ ID NO: 897518 - protein, 384 aa, Homo sapiens
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 897519 - protein, 424 aa, Homo sapiens
FPEEEAPGAAALLPGLWWTFSSKSFWLRTTGRRDWAFPSNMAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 897520 - protein, 97 aa, Homo sapiens; identical to SEQ ID NO: 897515

SEQ ID NO: 897521 - protein, 451 aa, Homo sapiens [sequence omitted]

SEQ ID NO: 897522 - protein, 128 aa, Homo sapiens; identical to SEQ ID NO: 897514

SEQ ID NO: 897523 - protein, 97 aa, Homo sapiens; identical to SEQ ID NO: 897515

SEQ ID NO: 897524 - protein, 97 aa, Homo sapiens; identical to SEQ ID NO: 897515

SEQ ID NO: 897525 - protein, 124 aa, Homo sapiens
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMAVENY

SEQ ID NO: 897526 - protein, 79 aa, Homo sapiens
LTVSWLFPVEKSWAPSLFPGTRYDIEFHDYACTLGYNPPGGRTSIVSFFVLPTEPVGDLHTGALQSVLIELLKAASLQS

SEQ ID NO: 897527 - protein, 128 aa, Homo sapiens; identical to SEQ ID NO: 897514

SEQ ID NO: 897528 - protein, 232 aa, Homo sapiens
GAWRVWSTGSRAWGGQGVESGSYSGGCRAQGSRVRPAQVQSAPPRPQQPLVRSGAPSLSQRATWAMAAVALASGTRLGLVLELLPGQPALPRARRESVTFEDVAVYFSENEWIGLGPAQRALYRDVMLENYGAVASLAAFPFPKPALISQLERGETPWCSVPRGALDGEAPRGISSGEILKLPGATIWSLRIKPIPKKTVTKQRETRSLVTSFEPLDQALPEAELPQNFSAM

SEQ ID NO: 897529 - protein, 249 aa, Homo sapiens
FPEEEAPGAAALLPGLWWTFSSKSFWLRTTGRRDWAFPSNMAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATNLMGLVVPLGPGSSNPPGIMGFFLVYKNHHLKKFPKRGFVWKT

SEQ ID NO: 897530 - protein, 384 aa, Homo sapiens; identical to SEQ ID NO: 897518

SEQ ID NO: 897531 - protein, 384 aa, Homo sapiens; identical to SEQ ID NO: 897518

SEQ ID NO: 897532 - protein, 407 aa, Homo sapiens [sequence omitted]

SEQ ID NO: 897533 - protein, 128 aa, Homo sapiens; identical to SEQ ID NO: 897514

SEQ ID NO: 897534 - protein, 192 aa, Homo sapiens
GAWRVWSTGSRAWGGQGVESGSYSGGCRAQGSRVRPAQVQSAPPRPQQPLVRSGAPSLSQRATWAMAAVALASGTRLGLVLELLPGQPALPRARRESVTFEDVAVYFSENEWIGLGPAQRALYRDVMLENYGAVASLAAFPFPKPALISQLERGETPWCSVPRGALDGEAPRGISSAPETFTFTQKGIKEVR

SEQ ID NO: 897535 - protein, 97 aa, Homo sapiens; identical to SEQ ID NO: 897515

SEQ ID NO: 897536 - protein, 97 aa, Homo sapiens; identical to SEQ ID NO: 897515

SEQ ID NO: 897537 - protein, 191 aa, Homo sapiens
MIFVNNLYSALKKGGWGMAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRVLSAMIRGAADGSRFQVWDYEEGEVEALLDRYFEADPPGQVAASPDPTT

SEQ ID NO: 897538 - protein, 170 aa, Homo sapiens [sequence omitted]

SEQ ID NO: 897539 - protein, 165 aa, Homo sapiens
MIFVNNLYSALKKGGWGMAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRGEHPKPPSWLSMDPALSSFPGGL

SEQ ID NO: 897540 - protein, 197 aa, Homo sapiens
MIFVNNLYSALKKGGWGMAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRVLSAMIRGAADGSRFQVWDYEEAATCPGGSASKYRSSRASTSPSSEVDAAANLVV

SEQ ID NO: 897541 - protein, 121 aa, Homo sapiens [sequence omitted]

SEQ ID NO: 897542 - protein, 191 aa, Homo sapiens; identical to SEQ ID NO: 897537

SEQ ID NO: 897543 - protein, 1125 aa, Homo sapiens
MFCVESLRERMFLEHELNLAPSRESGDLAVSCGQWPIPGSCPDWTLSSRRMPAPGAAVEVGNASLWSPRSLRRRQGDQPSPRTCSAPPTPSASPPAQLCRIPASRHSTSSGPCTTWCPPVTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 897544 - protein, 1182 aa, Homo sapiens
PRVRNYSVRPRPQGGAPPVSWRVVRGSSTPAPCQDRPASAGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 897545 - protein, 325 aa, Homo sapiens
MKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 897546 - protein, 1125 aa, Homo sapiens; identical to SEQ ID NO: 897543

SEQ ID NO: 897547 - protein, 1125 aa, Homo sapiens; identical to SEQ ID NO: 897543

SEQ ID NO: 897548 - protein, 1125 aa, Homo sapiens; identical to SEQ ID NO: 897543

SEQ ID NO: 897549 - protein, 1125 aa, Homo sapiens; identical to SEQ ID NO: 897543

SEQ ID NO: 897550 - protein, 1095 aa, Homo sapiens
MFCVESLRERMFLEHELNLAPSRESGDLAVSCGQWPIPGSCPDWTLSSRRMPAPGAAVEVGNASLWSPRSLRRRQGDQPSPRTCSAPPTPSASPPAQLCRIPASRHSTSSGPCTTWCPPVTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAVSWEGMETFKHATF

SEQ ID NO: 897551 - protein, 115 aa, Homo sapiens
IPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGNEAASPCSALGCG

SEQ ID NO: 897552 - protein, 1157 aa, Homo sapiens
QHVSAEVELRGPGMKGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 897553 - protein, 1154 aa, Homo sapiens
MFGLKPPLYFLPGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 897554 - protein, 122 aa, Homo sapiens
MLLCLKPSLLLPQRWGQSHSSPGVKLASAEKVGCIVSKKGLFVSFYFPAKFSSKQQVLGAHKATQRLFPGKALSYLKIKPIHKLKVAFYYSVGSMYRALCIHSFTPTRLLLQWVGFSYRRKF

SEQ ID NO: 897555 - protein, 122 aa, Homo sapiens; identical to SEQ ID NO: 897554

SEQ ID NO: 897556 - protein, 1125 aa, Homo sapiens; identical to SEQ ID NO: 897543

SEQ ID NO: 897557 - protein, 1125 aa, Homo sapiens; identical to SEQ ID NO: 897543

SEQ ID NO: 897558 - protein, 708 aa, Homo sapiens
MFCVESLRERMFLEHELNLAPSRESGDLAVSCGQWPIPGSCPDWTLSSRRMPAPGAAVEVGNASLWSPRSLRRRQGDQPSPRTCSAPPTPSASPPAQLCRIPASRHSTSSGPCTTWCPPVTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDAGLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEVLGSPPHGH

SEQ ID NO: 897559 - protein, 219 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFV

SEQ ID NO: 897560 - protein, 219 aa, Homo sapiens; identical to SEQ ID NO: 897559

SEQ ID NO: 897561 - protein, 81 aa, Homo sapiens
TIKTATNSLHKYPNPSTPRGKKKKALPASETPKAAESAEPPGKAKEAKEKAKETALAATEKAKDLASKAATKKQQQQQQFV

SEQ ID NO: 897562 - protein, 219 aa, Homo sapiens; identical to SEQ ID NO: 897559

SEQ ID NO: 897563 - protein, 208 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGEAPSKTLVETAKEAKEKERLEYEKQAPPGPKRRVGSF

SEQ ID NO: 897564 - protein, 208 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQAKEAKEKAKETALAATEKAKDLASKAATKKQQQQQQFV

SEQ ID NO: 897565 - protein, 194 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTGISGQAAGKALPTGGHAGAREGRNGRPPAGPKGPRA

SEQ ID NO: 897566 - protein, 145 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQL

SEQ ID NO: 897567 - protein, 112 aa, Homo sapiens [sequence omitted]

SEQ ID NO: 897568 - protein, 83 aa, Homo sapiens
SSVGFSYAVHELGFAPTHPPCPMKGFEYILAKLQGEAPSKTLVETAKEAKEKAKETALAATEKAKDLASKAATKKQQQQQQFV

SEQ ID NO: 897569 - protein, 219 aa, Homo sapiens; identical to SEQ ID NO: 897559

SEQ ID NO: 897570 - protein, 249 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFVSTPPRPEVGSPCLLLSFLNKSAGGVLWWGA

SEQ ID NO: 897571 - protein, 219 aa, Homo sapiens; identical to SEQ ID NO: 897559

SEQ ID NO: 897572 - protein, 249 aa, Homo sapiens; identical to SEQ ID NO: 897570

SEQ ID NO: 897573 - protein, 299 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQRDNLGMVFPGIVLKGSHLPFRDRARPLPKHLLRQPRKPRRRQRRRHWQLQRRPRTSPARRPPRSSSSSNSLCSQSTTTTAPQTARLSPSALPSLYFIIKNQLPALSAVYVVGCGDAVWHLQYTKHMIHV

SEQ ID NO: 897574 - protein, 256 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQVSSVLGLLGLWDPVLSVSGLGWGQWATSVSFHSHLMPEFGLARFKSNVTKTMKGFEYILAKLQGEAPSKTLVETAKEAKEKAKETALAATEKAKDLASKAATKKQQQQQQFV

SEQ ID NO: 897575 - protein, 192 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQCSSVVVGCSGLCRPRCFSMFGAWAGGHVGQSHHCCFLFELGYLLLEVQ

SEQ ID NO: 897576 - protein, 107 aa, Homo sapiens
VYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFV

SEQ ID NO: 897577 - protein, 1150 aa, Homo sapiens
MAAALGPPEVIAQLENAAKVLMAPPSMVNNEQRQHAEHIFLSFRKSKSPFAVCKHILETSKVDYVLFQAATAIMEAVVREWILLEKGSIESLRTFLLTYVLQRPNLQKYVREQILLAVAVIVKRGSLDKSIDCKSIFHEVSQLISSGNPTVQTLACSILTALLSEFSSSSKTSNIGLSMEFHGNCKRVFQEEDLRQIFMLTVEVLQEFSRRENLNAQMSSVFQRYLALANQVLSWNFLPPNLGRHYIAMFESSQNVLLKPTESWRETLLDSRVMELFFTVHRKIREDSDMAQDSLQCLAQLASLHGPIFPDEGSQVDYLAHFIEGLLNTINGIEIEDSEAVGISSIISNLITVFPRNVLTAIPSELFSSFVNCLTHLTCSFGRSAALEEVLDKDDMVYMEAYDKLLESWLTLVQDDKHFHKGFFTQHAVQVFNSYIQCHLAAPDGTRNLTANGVASREEEEISELQEDDRDQFSDQLASVGMLGRIAAEHCIPLLTSLLEERVTRLHGQLQRHQQQLLASPGSSTVDNKMLDDLYEDIHWLILVTGYLLADDTQGETPLIPPEIMEYSIKHSSEVDINTTLQILGSPGEKASSIPGYNRTDSVIRLLSAILRVSEVESRAIRADLTHLLSPQMGKDIVWFLKRWAKTYLLVDEKLYDQISLPFSTAFGADTEGSQWIIGYLLQKVISNLSVWSSEQDLANDTVQLLVTLVERRERANLVIQCENWWNLAKQFASRSPPLNFLSSPVQRTLMKALVLGGFAHMDTETKQQYWTEVLQPLQQRFLRVINQENFQQMCQQEEVKQEITATLEALCGIAEATQIDNVAILFNFLMDFLTNCIGLMEVYKNTPETVNLIIEVFVEVAHKQICYLGESKAMNLYEACLTLLQVYSKNNLGRQRIDVTAEEEQYQDLLLIMELLTNLLSKEFIDFSDTDEVFRGHEPGQAANRSVSAADVVLYGVNLILPLMSQDLLKFPTLCNQYYKLITFICEIFPEKIPQLPEDLFKSLMYSLELGMTSMSSEVCQLCLEALTPLAEQCAKAQETDSPLFLATRHFLKLVFDMLVLQKHNTEMTTAAGEAFYTLVCLHQAEYSELVETLLSSQQDPVIYQRLADAFNKLTASSTPPTLDRKQKMAFLKSLEEFMANVGGLLCVK

SEQ ID NO: 897578 - protein, 1150 aa, Homo sapiens; identical to SEQ ID NO: 897577

SEQ ID NO: 897579 - protein, 1150 aa, Homo sapiens; identical to SEQ ID NO: 897577

SEQ ID NO: 897580 - protein, 170 aa, Homo sapiens
MAAALGPPEVIAQLENAAKVLMAPPSMVNNEQRQHAEHIFLSFRKSKSPFAVCKHILETSKVDYVLFQAATAIMEAVVREWILLEKGSIESLRTFLLTYVLQRPNLQKYVREQILLAVAVIVKRGSLDKSIDCKSIFHEVSQLISSGNPTVVSVLFVFININNLYFLLHK

SEQ ID NO: 897581 - protein, 1150 aa, Homo sapiens; identical to SEQ ID NO: 897577

SEQ ID NO: 897582 - protein, 755 aa, Homo sapiens [sequence omitted]

SEQ ID NO: 897583 - protein, 247 aa, Homo sapiens
MAAALGPPEVIAQLENAAKVLMAPPSMVNNEQRQHAEHIFLSFRKSKSPFAVCKHILETSKVDYVLFQAATAIMEAVVREWILLEKGSIESLRTFLLTYVLQRPNLQKYVREQILLAVAVIVKRGSLDKSIDCKSIFHEVSQLISSGNPTVQTLACSILTALLSEFSSSSKTSNIGLSMEFHGNCKRVFQEEDLRQIFMLTVEVLQEFSRRENLNAQMSSVFQRYLALANQVLSWNFLPPNSNWIIE

SEQ ID NO: 897584 - protein, 423 aa, Homo sapiens [sequence omitted]

SEQ ID NO: 897585 - protein, 423 aa, Homo sapiens [sequence omitted]

SEQ ID NO: 897586 - protein, 117 aa, Homo sapiens
MGSTKHWGEWLLNLKVAPAGVFGVAFLARVALVFYGVFQDRTLHVRYTDIDYQVFTDAARFVTEGRSPYLRATYRYTPLLGWLLTPNIYLSELFGKFLFISCDLLPTPNSEIVRYRA

SEQ ID NO: 897587 - protein, 423 aa, Homo sapiens [sequence omitted]

SEQ ID NO: 897588 - protein, 239 aa, Homo sapiens
MQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897589 - protein, 82 aa, Homo sapiens
KLKLYEFHVSSFWIFFPGSHPVRGVQVMKVGKLQLHQGMFPQAMKNLRLAFDIMRVTHGREHSLIEDLILLLEECDANIRAS

SEQ ID NO: 897590 - protein, 209 aa, Homo sapiens
MQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLVGI

SEQ ID NO: 897591 - protein, 87 aa, Homo sapiens
FNNRFVYILQIKNRFRVTIFFPGSHPVRGVQVMKVGKLQLHQGMFPQAMKNLRLAFDIMRVTHGREHSLIEDLILLLEECDANIRAS

SEQ ID NO: 897592 - protein, 404 aa, Homo sapiens
MIIAHCSRELLGSRDPPTTCPNLDYSVREQRKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897593 - protein, 369 aa, Homo sapiens
MRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897594 - protein, 460 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897595 - protein, 460 aa, Homo sapiens; identical to SEQ ID NO: 897594

SEQ ID NO: 897596 - protein, 460 aa, Homo sapiens; identical to SEQ ID NO: 897594

SEQ ID NO: 897597 - protein, 423 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEEDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897598 - protein, 239 aa, Homo sapiens; identical to SEQ ID NO: 897588

SEQ ID NO: 897599 - protein, 460 aa, Homo sapiens; identical to SEQ ID NO: 897594

SEQ ID NO: 897600 - protein, 300 aa, Homo sapiens
MRLSTQRFCEPTAAHWKTRLGLIFQIIYSACSEIDAQDTKQPLDTSAKNVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897601 - protein, 239 aa, Homo sapiens; identical to SEQ ID NO: 897588

SEQ ID NO: 897602 - protein, 276 aa, Homo sapiens
CCGGCARDILFFFVFGAPRPPLRGLVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897603 - protein, 395 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRLLIL

SEQ ID NO: 897604 - protein, 460 aa, Homo sapiens; identical to SEQ ID NO: 897594

SEQ ID NO: 897605 - protein, 375 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACMLLIL

SEQ ID NO: 897606 - protein, 391 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYS

SEQ ID NO: 897607 - protein, 113 aa, Homo sapiens
LPHPQGLQQNLKYGPLDWKLKKTRKESSFKKLSSICPDSWCCFRIFFPGSHPVRGVQVMKVGKLQLHQGMFPQAMKNLRLAFDIMRVTHGREHSLIEDLILLLEECDANIRAS

SEQ ID NO: 897608 - protein, 89 aa, Homo sapiens
ILTTRYTTTLATTIGEFWLPIFFPGSHPVRGVQVMKVGKLQLHQGMFPQAMKNLRLAFDIMRVTHGREHSLIEDLILLLEECDANIRAS

SEQ ID NO: 897609 - protein, 236 aa, Homo sapiens
TGDQAPSAQEPACLLLLFMVPGLSPDFAPRSEWASIAERSQAAEAGISETVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRLLIL

SEQ ID NO: 897610 - protein, 188 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESDNTCKSPQHLFPTLLNLTINHVYHKKVQPVNGSRLR

SEQ ID NO: 897611 - protein, 411 aa, Homo sapiens
WILEIPPLLLLSCLAVIKLFLCCNTPTVLRVLAFLGSRKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897612 - protein, 82 aa, Homo sapiens
PCVNDSLNIHRYTIFFPGSHPVRGVQVMKVGKLQLHQGMFPQAMKNLRLAFDIMRVTHGREHSLIEDLILLLEECDANIRAS

SEQ ID NO: 897613 - protein, 231 aa, Homo sapiens
MRLSTQRFCEPTAAHWKTRLGLIFQIIYSACSEIDAQDTKQPLDTSAKNVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYS

SEQ ID NO: 897614 - protein, 460 aa, Homo sapiens; identical to SEQ ID NO: 897594

SEQ ID NO: 897615 - protein, 391 aa, Homo sapiens; identical to SEQ ID NO: 897606

SEQ ID NO: 897616 - protein, 486 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKRWGLAMLPRLVFNSWYQVIFLPQPHKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897617 - protein, 239 aa, Homo sapiens; identical to SEQ ID NO: 897588

SEQ ID NO: 897618 - protein, 460 aa, Homo sapiens; identical to SEQ ID NO: 897594

SEQ ID NO: 897619 - protein, 460 aa, Homo sapiens; identical to SEQ ID NO: 897594

SEQ ID NO: 897620 - protein, 437 aa, Homo sapiens
WILEIPPLLLLSCLAVIKLFLCCNTPTVLRVLAFLGSRKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKRWGLAMLPRLVSSSWYQVIFLPQPHKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897621 - protein, 270 aa, Homo sapiens
MALLYARPVRPPLHPKPVRVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 897622 - protein, 239 aa, Homo sapiens; identical to SEQ ID NO: 897588

SEQ ID NO: 897623 - protein, 391 aa, Homo sapiens; identical to SEQ ID NO: 897606

SEQ ID NO: 897624 - protein, 409 aa, Homo sapiens
CARRAQARGSRQPVRRPLLDAGSRLRCRSCGRMEPLKVEKFATANRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKES

SEQ ID NO: 897625 - protein, 133 aa, Homo sapiens
MQEVGVGLYPSISLLNHSCDPNCSIVFNGPHLLLRAVRDIEVGEEDADMLTGDEQVWKEVQESLKKIEELKAHWKWEQVLAMCQAIISSNSERLPDINIYQLKVLDCAMDACINLGLLEEALFYGTRTMEPYS

SEQ ID NO: 897626 - protein, 84 aa, Homo sapiens
LIHTLLPPPPKQKSWIFFPGSHPVRGVQVMKVGKLQLHQGMFPQAMKNLRLAFDIMRVTHGREHSLIEDLILLLEECDANIRAS

SEQ ID NO: 897627 - protein, 133 aa, Homo sapiens; identical to SEQ ID NO: 897625

SEQ ID NO: 897628 - protein, 687 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 897629 - protein, 687 aa, Homo sapiens; identical to SEQ ID NO: 897628

SEQ ID NO: 897630 - protein, 693 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 897631 - protein, 687 aa, Homo sapiens; identical to SEQ ID NO: 897628

SEQ ID NO: 897632 - protein, 687 aa, Homo sapiens; identical to SEQ ID NO: 897628

SEQ ID NO: 897633 - protein, 687 aa, Homo sapiens; identical to SEQ ID NO: 897628

SEQ ID NO: 897634 - protein, 512 aa, Homo sapiens
MCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 897635 - protein, 512 aa, Homo sapiens; identical to SEQ ID NO: 897634

SEQ ID NO: 897636 - protein, 386 aa, Homo sapiens
GRVGRRTRGSTHASAVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 897637 - protein, 201 aa, Homo sapiens [sequence omitted]

SEQ ID NO: 897638 - protein, 693 aa, Homo sapiens; identical to SEQ ID NO: 897630

SEQ ID NO: 897639 - protein, 693 aa, Homo sapiens; identical to SEQ ID NO: 897630

SEQ ID NO: 897640 - protein, 693 aa, Homo sapiens; identical to SEQ ID NO: 897630

SEQ ID NO: 897641 - protein, 108 aa, Homo sapiens
MGPRADLQGQSPGGGEALCQEHSSSSPTSEPRPPPSLSPPVLPPSSLGFSSSPRASLLLRSQLGVPDSNAVFWGVVSRSCLVSAVNVCLLHKPRPAPEPGSVPMRGLG

SEQ ID NO: 897642 - protein, 194 aa, Homo sapiens [sequence omitted]

SEQ ID NO: 897643 - protein, 153 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKQLLELQGQGAIIPAWESWKTSCRSQRSILTLKMGRMFFLRTNSFVF

SEQ ID NO: 897644 - protein, 693 aa, Homo sapiens; identical to SEQ ID NO: 897630

SEQ ID NO: 897645 - protein, 687 aa, Homo sapiens; identical to SEQ ID NO: 897628

SEQ ID NO: 897646 - protein, 687 aa, Homo sapiens; identical to SEQ ID NO: 897628

SEQ ID NO: 897647 - protein, 687 aa, Homo sapiens; identical to SEQ ID NO: 897628

SEQ ID NO: 897648 - protein, 618 aa, Homo sapiens
LVRPGVNGIVDPGRPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 897649 - protein, 421 aa, Homo sapiens
LTYCSEKNKTQMIYRNEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 897650 - protein, 693 aa, Homo sapiens; identical to SEQ ID NO: 897630

SEQ ID NO: 897651 - protein, 114 aa, Homo sapiens
MKQRCGLVAHCLWPPSPAQPQASQPQTLESPTTMERWAVAMVDGLPGWAFELALGTTRLSLSSHGTQKCAAMLPRVLSPHLSQPSWRPGLSLQPLGPALIAGGQALDLEGLAHP

SEQ ID NO: 897652 - protein, 693 aa, Homo sapiens; identical to SEQ ID NO: 897630

SEQ ID NO: 897653 - protein, 687 aa, Homo sapiens; identical to SEQ ID NO: 897628

SEQ ID NO: 897654 - protein, 196 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSKATSRRREQLGSGLEAGKAKCKVDWALGVCNAE

SEQ ID NO: 897655 - protein, 194 aa, Homo sapiens [sequence omitted]

SEQ ID NO: 897656 - protein, 125 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVVSIEEEFVLGSGV

SEQ ID NO: 897657 - protein, 242 aa, Homo sapiens [sequence omitted]

SEQ ID NO: 897658 - protein, 242 aa, Homo sapiens [sequence omitted]

SEQ ID NO: 897659 - protein, 249 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 897660 - protein, 249 aa, Homo sapiens; identical to SEQ ID NO: 897659

SEQ ID NO: 897661 - protein, 173 aa, Homo sapiens
ASDDLVRYNLSSSRQFIFLCVQRHIGFAFNDLLRLENTIKTNCSATGQVVYYQIITSRCQLHIESFMKFINKELFFLCGFNKSSRIVQSLVNVILIIPLNFICCCYLLKYDLFRLLIPLIQEMPRGIPWGNGASYSVNFSSFTFANIMAEFFLSLVRQLLTEFFILTILSHGI

SEQ ID NO: 897662 - protein, 217 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLGITPPGNAPTVTSMSSINNTVATPASYHTKDDPRGLSVLKQEKQKNDMYLSNWSLNASNQMDLCPTVVTYDPNKELLV

SEQ ID NO: 897663 - protein, 249 aa, Homo sapiens; identical to SEQ ID NO: 897659

SEQ ID NO: 897664 - protein, 249 aa, Homo sapiens; identical to SEQ ID NO: 897659

SEQ ID NO: 897665 - protein, 152 aa, Homo sapiens
YYYKIQRPSTLLRLENTIKTNCSATGQVVYYQIITSRCQLHIESFMKFINKELFFLCGFNKSSRIVQSLVNVILIIPLNFICCCYLLKYDLFRLLIPLIQEMPRGIPWGNGASYSVNFSSFTFANIMAEFFLSLVRQLLTEFFILTILSHGI

SEQ ID NO: 897666 - protein, 242 aa, Homo sapiens [sequence omitted]

SEQ ID NO: 897667 - protein, 404 aa, Homo sapiens
EEESRVWPGTFPAKRRAEPKTKQTTSERLGAGLTAAGLASRAKAFRRVGFWVVDRGGRAVCGRAETRGAMATFVSELEAAKKNLSEALGDNVKQYWANLKLWFKQKISKEEFDLEAHRLLTQDNVHSHNDFLLAILTRCQILVSTPDGAGSLPWPGGSAAKPGKPKGKKKLSSVRQKFDHRFQPQNPLSGAQQFVAKDPQDDDDLKLCSHTMMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQQAALLLACSGDTLPASLPPVNMYDLFEALQVHREVIPTHTVYALNIERIITKLWHPNHEELQQDKVHRQRLAAKEGLLLC

SEQ ID NO: 897668 - protein, 193 aa, Homo sapiens
MMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQQAALLLACSGDTLPASLPPVNMYDLFEALQVHREVIPTHTVYALNIERIITKLWHPNHEELQQDKVHRQRLAAKEGLLLC

SEQ ID NO: 897669 - protein, 404 aa, Homo sapiens; identical to SEQ ID NO: 897667

SEQ ID NO: 897670 - protein, 363 aa, Homo sapiens
EEESRVWPGTFPAKRRAEPKTKQTTSERLGAGLTAAGLASRAKAFRRVGFWVVDRGGRAVCGRAETRGAMATFVSELEAAKKNLSEALGDNVKQYWANLKLWFKQKISKEEFDLEAHRLLTQDNVHSHNDFLLAILTRCQILVSTPDGAGSLPWPGGSAAKPGKPKGKKKLSSVRQKFDHRFQPQNPLSGAQQFVAKDPQDDDDLKLCSHTMMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQQAALLLACSGDTLPASLPPVNMYDLFEALQVSLGSLKFT

SEQ ID NO: 897671 - protein, 397 aa, Homo sapiens
LRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 897672 - protein, 278 aa, Homo sapiens
LRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKSYVH

SEQ ID NO: 897673 - protein, 213 aa, Homo sapiens
LRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWSSLPTSR

SEQ ID NO: 897674 - protein, 906 aa, Homo sapiens
IWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSILLKKIERETWRESGVSLIATVTRLMERLLDYSNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 897675 - protein, 825 aa, Homo sapiens
IWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSILLKKIERETWRESGVSLIATVTRLMERLLDYSNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARGQCQSVGKTEGAQENLLVLGTVASCHTFRLSPPNRCSTTTMLMILSLLLFPASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQ

SEQ ID NO: 897676 - protein, 765 aa, Homo sapiens
MAGKWRFINCYCNSSNGEVVRLQNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 897677 - protein, 241 aa, Homo sapiens
MLMILSLLLFPASPLLSDKHKHSRENSCLSPRERPCSAIYPTPVEPSQRMLFNHIGDGALPRSDPNLSAPEKASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 897678 - protein, 775 aa, Homo sapiens
IWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGKGDETYRELFNSILLKKIERETWRESGVSLIATVTRLMERLLDYSNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQT

SEQ ID NO: 897679 - protein, 92 aa, Homo sapiens
MTKLEEHLEGIVNIFHQYSVRKGHFDTLSKGELKQLLTKELANTIKNIKDKAVIDEIFQGLDANQDEQVDFQEFISLVAIALKAAHYHTHKE

SEQ ID NO: 897680 - protein, 92 aa, Homo sapiens; identical to SEQ ID NO: 897679

SEQ ID NO: 897681 - protein, 299 aa, Homo sapiens
MSSIKIECVLPENCRCGESPVWEEVSNSLLFVDIPAKKVCRWDSFTKQVQRVTMDAPVSSVALRQSGGYVATIGTKFCALNWKEQSAVVLATVDNDKKNNRFNDGKVDPAGRYFAGTMAEETAPAVLERHQGALYSLFPDHHVKKYFDQVDISNGLDWSLDHKIFYYIDSLSYSVDAFDYDLQTGQISNRRSVYKLEKEEQIPDGMCIDAEGKLWVACYNGGRVIRLDPVTGKRLQTVKLPVDKTTSCCFGGKNYSEMYVTCARDGMDPEGLLRQPEAGGIFKITGLGVKGIAPYSYAG

SEQ ID NO: 897682 - protein, 299 aa, Homo sapiens; identical to SEQ ID NO: 897681

SEQ ID NO: 897683 - protein, 191 aa, Homo sapiens
MSSIKIECVLPENCRCGESPVWEEVSNSLLFVDIPAKKVCRWDSFTKQVQRVTMDAPVSSVALRQSGGYVATIGTKFCALNWKEQSAVVLATVDNDKKNNRFNDGKVDPAGRYFAGTMAEETAPAVLERHQGALYSLFPDHHVKKYFDQVDISNGLDWSLDHKIFYYIDSLQPQKCLQARKGRTNPRWNVY

SEQ ID NO: 897684 - protein, 224 aa, Homo sapiens
MADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 897685 - protein, 266 aa, Homo sapiens
RNIRLGTRLGGQARRRWLHCVYCIPWLVYLYISRDVKLTVKSMADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 897686 - protein, 266 aa, Homo sapiens; identical to SEQ ID NO: 897685

SEQ ID NO: 897687 - protein, 133 aa, Homo sapiens
MADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLE

SEQ ID NO: 897688 - protein, 226 aa, Homo sapiens
GKHTARYEAGWCFLLFANCRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 897689 - protein, 226 aa, Homo sapiens
HLRLGRGPCKSDRGQARRRWLHCVYCIPWLVYLYISRDVKLTVKSMADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFERQQPPPMKACLSCHQQIHRNAPICPLCKAKSRSRNPKKPKRKQDE

SEQ ID NO: 897690 - protein, 83 aa, Homo sapiens
TSSLSLVSAEFEALESEERHLKEYKQEMDLLLQEKMAHVEELRLIHADINVMENTIKQSENDLNNPTALLSTKARFPGKVTRR

SEQ ID NO: 897691 - protein, 201 aa, Homo sapiens
MEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 897692 - protein, 269 aa, Homo sapiens
TIRLGRGPCKSDRGQARRRWLHCVYCIPWLVYLYISRDVKLTVKSMADEQEIMCKLESIKEIRNKTLQMEKIKARLKAEFEALESEERHLKEYKQEMDLLLQEKMAHVEELRLIHADINVMENTIKQSENDLNKLLESTRRLHDEYKPLKEHVDALRMTLGLQRLPDLCEEEEKLSLDYFEKQKAEWQTEPQEPPIPESLAAAAAAAQQLQVARKQDTRQTATFRQQPPPMKACLSCHQQIHRNAPICPLCKAKSRSRNPKKPKRKQDE

SEQ ID NO: 897693 - protein, 201 aa, Homo sapiens; identical to SEQ ID NO: 897691

SEQ ID NO: 897694 - protein, 201 aa, Homo sapiens; identical to SEQ ID NO: 897691

SEQ ID NO: 897695 - protein, 266 aa, Homo sapiens; identical to SEQ ID NO: 897685

SEQ ID NO: 897696 - protein, 453 aa, Homo sapiens
STAAPPSCERLRARERKSKRARERATGTRPTPPLSPTARSACLSTPPDSTRPGPCAGTAQSSGAVQAASGLSGAPPRPQTKAWPAAPARCALAPRLPSSSPLIPPRAWLGALRPAAKFPGRQRRLRLASAMAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 897697 - protein, 453 aa, Homo sapiens; identical to SEQ ID NO: 897696

SEQ ID NO: 897698 - protein, 453 aa, Homo sapiens; identical to SEQ ID NO: 897696

SEQ ID NO: 897699 - protein, 303 aa, Homo sapiens
SVSPHRSALRVCSVPGWLQERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 897700 - protein, 519 aa, Homo sapiens
DPAPLGAPLWSDFSSTFRQETGHSLSPASCLPQRDLSIFPEANRPGLRGDHCACLSFLFWSRGRPGSLPKGGCALSGRRSGRAGAGRTPAPVVTGANAAGRLQPAGEQACRCWWRHGLLSVERGAAPPAAKRHGPLPGLGSPAAATQQVRGHLGGLHSEGCVQGPGALAPERLTAHSCPAESQEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897701 - protein, 161 aa, Homo sapiens
SLCGARNLWGWVSTISSWLRSSSQTGASSCKSGGCLRTPLFQQYPYLPHSSVPDSGPGGFGRAPPTLSMGGPCRQRLRHSERLIHTSVLARTLSLWGKLSLWGTLSLWGEREGPCLTATGPLVSCSLSILFSPQCSRAAVEPMMKTTCFWQPCCAPVPPQR

SEQ ID NO: 897702 - protein, 454 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897703 - protein, 400 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGRCFCSSPTLLYLPLPSLLCLGELRGVG

SEQ ID NO: 897704 - protein, 437 aa, Homo sapiens
MVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897705 - protein, 377 aa, Homo sapiens
MVFCLSSEEPRRPLRSDMVHFQASEVQQLLHNKFVVILGDSKYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897706 - protein, 119 aa, Homo sapiens
GSVAEAKKPTAGGWGYSQLAGCGTGMLHREGQPYGLGLNGQCSIGFLVQPQSPTVTGAAWCSSPRAPSLGLWWRLLRAPLPLVLRHCSPSHLNCNTLLQNLCFHVNTLVPACTQRGHHG

SEQ ID NO: 897707 - protein, 119 aa, Homo sapiens; identical to SEQ ID NO: 897706

SEQ ID NO: 897708 - protein, 315 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPGEPYHKWGGSDALGPSEDRAQKQNGTQPLKGSRGP

SEQ ID NO: 897709 - protein, 127 aa, Homo sapiens
RGEAAAAAITTVGSLTWLPPRDPSPYLGFAPAKWAQPWLLRPVAATSIALLSLRALGVAQGGTWVNGSGSCERRSPRRRGLRRRRGHRDARMESAGRWAVHRRLTWTHGLCGAGALQNRLADWGAGT

SEQ ID NO: 897710 - protein, 127 aa, Homo sapiens; identical to SEQ ID NO: 897709

SEQ ID NO: 897711 - protein, 428 aa, Homo sapiens
DPAPLGAPLWSDFSSTFRQETGHSLSPASCLPQRDLSIFPEANRPGLRGDHCACLSFLFWSRGRPGSLPKGGCALSGRRSGRAGAGRTPAPVVTGANAAGRLQPAGEQACRCWWRHGLLSVERGAAPPAAKRHGPLPGLGSPAAATQQVRGHLGGLHSEGCVQGPGALAPERLTAHSCPAESQEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897712 - protein, 102 aa, Homo sapiens
GSVAEAKKPTAGGWGYSQLAGCGTGMLHREGQPYGLGLNGQCSIGFLVQPQSPTVTGAAWCSSPRAPSLGLWWRLLRAPPTLPPLSSPVECWSHSLGKSGEK

SEQ ID NO: 897713 - protein, 301 aa, Homo sapiens
MESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897714 - protein, 415 aa, Homo sapiens
YARLLALTRVCWPLRASAGPYARLLALTRGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897715 - protein, 363 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897716 - protein, 344 aa, Homo sapiens
APEDPSGLCISYALCAHQFKETAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897717 - protein, 286 aa, Homo sapiens
RWDSRLVDRTPCFQTLLRSVALRGCTFSLQLQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 897718 - protein, 119 aa, Homo sapiens; identical to SEQ ID NO: 897706

SEQ ID NO: 897719 - protein, 191 aa, Homo sapiens
GNELEVSIMMVVEALCELHCPEAIQGIAVWSSSIVGKHLLWINSVAQQAEGRFEKASVEYQEHLCAMTGVDCCISSFDKSVLTLASAGCKSASLKHCLNGESRKSVLSKPTDSSPEVINYLGNKACECYISTADWAAVQEWQNAIHDLKKSTSSTSLNLKADFNYIKSLSSFESWKIGQRPGKFEWSPEKF

SEQ ID NO: 897720 - protein, 212 aa, Homo sapiens
GNELEVSIMMVVEALCELHCPEAIQGIAVWSSSIVGKHLLWINSVAQQAEGRFEKASVEYQEHLCAMTGVDCCISSFDKSVLTLASAGCKSASLKHCLNGESRKSVLSKPTDSSPEVINYLGNKACECYISTADWAAVQEWQNAIHDLKKSTSSTSLNLKADFNYIKSLSSFESGKFVECTEQLELLPGENINLLAGGSKEKIDMKKLLRNM

SEQ ID NO: 897721 - protein, 212 aa, Homo sapiens; identical to SEQ ID NO: 897720

SEQ ID NO: 897722 - protein, 212 aa, Homo sapiens; identical to SEQ ID NO: 897720

SEQ ID NO: 897723 - protein, 212 aa, Homo sapiens; identical to SEQ ID NO: 897720

SEQ ID NO: 897724 - protein, 75 aa, Homo sapiens
FFETETHSVTQAGVQWHDFGSLQPPPPEFKQLSCLILRSTWDYRCVPPCPAHFCILSRDGISPCWPGWSQTPGLN

SEQ ID NO: 897725 - protein, 75 aa, Homo sapiens; identical to SEQ ID NO: 897724

SEQ ID NO: 897726 - protein, 121 aa, Homo sapiens
ETESHSVTQARVQWHDLGSLQPPPPRFKRFLSLSLLSSWDYRHMPPCPDNFCIFSRGGVSPYWPSWSRTPDMIRTPRPPNVLGLPPDSFSQSFMFWSYDIVFCCHMTDLFLLNVRYLLKNV

SEQ ID NO: 897727 - protein, 298 aa, Homo sapiens
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSAD

SEQ ID NO: 897728 - protein, 234 aa, Homo sapiens
CTRGSRTRVSLPSGQLTLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSAD

SEQ ID NO: 897729 - protein, 212 aa, Homo sapiens; identical to SEQ ID NO: 897720

SEQ ID NO: 897730 - protein, 212 aa, Homo sapiens; identical to SEQ ID NO: 897720

SEQ ID NO: 897731 - protein, 75 aa, Homo sapiens; identical to SEQ ID NO: 897724

SEQ ID NO: 897732 - protein, 212 aa, Homo sapiens; identical to SEQ ID NO: 897720

SEQ ID NO: 897733 - protein, 212 aa, Homo sapiens; identical to SEQ ID NO: 897720

SEQ ID NO: 897734 - protein, 212 aa, Homo sapiens; identical to SEQ ID NO: 897720

SEQ ID NO: 897735 - protein, 72 aa, Homo sapiens
FEKASVEYQEHLCAMTGVDCCISSFDKSVLTLASAGCKSASLKHCLNGERSAFLNKAKVIVIYFVLMILSCF

SEQ ID NO: 897736 - protein, 117 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTV

SEQ ID NO: 897737 - protein, 229 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIEQYHAHLKGSKHQTNLKNK

SEQ ID NO: 897738 - protein, 102 aa, Homo sapiens
MQAKSDCITCFTPGMEGVLPRGSGQKMEVMPTWWIRTSAAHSATCHSLEQGPLRRDQVCQFLCLQRDEAPRATPYSTRGKGVGWEESILLFWKAHSRPTNLL

SEQ ID NO: 897739 - protein, 229 aa, Homo sapiens; identical to SEQ ID NO: 897737

SEQ ID NO: 897740 - protein, 206 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMPCMDQLGSGWGCPVSLTTIGNPSSCVSNFWTPTVFHQELRWQQLSEQ

SEQ ID NO: 897741 - protein, 297 aa, Homo sapiens
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSLNMAIFASVCLASRLPRSLHAFIMVTFAIQIFALWPMLQKKLKACTPRSYVGVTLLFAFSAVGGLLSISAVGAVLFALLLMSISCLCPFYLIRLQLFKENIHGPWDEAEIKEDLSRFLS

SEQ ID NO: 897742 - protein, 40 aa, Homo sapiens
MINLCICFLKGEDGEKNRKLLADIRGHKMSSSFVQMTFSC

SEQ ID NO: 897743 - protein, 297 aa, Homo sapiens; identical to SEQ ID NO: 897741

SEQ ID NO: 897744 - protein, 297 aa, Homo sapiens; identical to SEQ ID NO: 897741

SEQ ID NO: 897745 - protein, 280 aa, Homo sapiens
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSLNMAIFASVCLASRLPRSLHAFIMVTFAIQIFALWPMLQKKLKACTPRSYVGVTLLFAFSAVGGLLSISAVGAAHALGAAMRWERPCVGSGGSSRVGLRGQP

SEQ ID NO: 897746 - protein, 297 aa, Homo sapiens; identical to SEQ ID NO: 897741

SEQ ID NO: 897747 - protein, 297 aa, Homo sapiens; identical to SEQ ID NO: 897741

SEQ ID NO: 897748 - protein, 210 aa, Homo sapiens
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSFHSNSGQFIIALTEVQVVLVLYERFEIETSLG

SEQ ID NO: 897749 - protein, 673 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 897750 - protein, 673 aa, Homo sapiens; identical to SEQ ID NO: 897749

SEQ ID NO: 897751 - protein, 632 aa, Homo sapiens
HRFWAQGSSDGPNRYNDLWGPSSVLGEFSSASRCRMNRWHAPLTLAPSVVSLGFQDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 897752 - protein, 683 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKAVSSPFSLTAGYSHTRYSCLCLMFSKCSLRGRRQCVYWNMGVCIHTYAQNHWLLRWTFSIGPA

SEQ ID NO: 897753 - protein, 671 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 897754 - protein, 326 aa, Homo sapiens
GKGAFGKGRALRNTLGGDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 897755 - protein, 283 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWNPWKSLLCG

SEQ ID NO: 897756 - protein, 116 aa, Homo sapiens
RCRTGPRSSWKSSSATTTRVLEPATSTHCSRLSRRSRTCGVTSPTWRPMGWCPACKPRPPHGGHSHTATPPDSGTRPTSLLAAPLGSRPPADSAPKAPPTLTTPLGGAALCSSPPD

SEQ ID NO: 897757 - protein, 100 aa, Homo sapiens
VELVVKNPLCPLGQTVQSELFRSRLDSYVRSLPFFSAGLAEATYLKSQENSCLPGALPNLCQLGPHCKPPHPHPLSLSLSLSKKKKMGVQKKQSQKIYEG

SEQ ID NO: 897758 - protein, 750 aa, Homo sapiens
VLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRITKKNPKKAEKLERKKVYRAEYINFLENLKILEISEDCTYADVKALHTEITRNKDSTLDRVLPRVRFTRHGKELKALAQRGIGYHHSSMYFKEKEFVEILFVKGLIRVVTATETLALGIHMPCKSVVFAQDSVYLDALNYRQMSGRAGRRGQDLLGNVYFFDIPLPKIKRLLASSVPELRGQFPLSITLVLRLMLLASKGDDPEDAKAKVLSVLKHSLLSFKRRRAMETLKLYFLFSLQLLIKEDYLNKKGNPKKFAGLASYLHGHEPSNLVFVNFLKRGLFHNLCKPAWKGSQQFSQDVMEKLVLVLANLFGRKYIPAKFQNANLSFSQSKVILAELPEDFKAALYEYNLAVMKDFASFLLIASKSVNMKKEHQLPLSRIKFTGKECEDSQLVSHLMSCKKGRVAISPFVCLSGNTDNDLLRPETINQVILRTVGVSGTQAPLLWPWKLDNRGRRMPLNAYVLNFYKHNCLTRLDQKNGMRVGQLLKCLKDFAFNIQAISDSLSELCENKRDNVVLAFKQLSQTFYEKLQEMQIQMSQNHLE

SEQ ID NO: 897759 - protein, 216 aa, Homo sapiens
VLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRITKKKPKEG

SEQ ID NO: 897760 - protein, 179 aa, Homo sapiens
KVRLVRGWFKSAEGSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEQIRETDQALWHASPLG

SEQ ID NO: 897761 - protein, 209 aa, Homo sapiens
MLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEGCSQDGR

SEQ ID NO: 897762 - protein, 209 aa, Homo sapiens; identical to SEQ ID NO: 897761

SEQ ID NO: 897763 - protein, 169 aa, Homo sapiens
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEQIRETDQALWHASPLG

SEQ ID NO: 897764 - protein, 169 aa, Homo sapiens; identical to SEQ ID NO: 897763

SEQ ID NO: 897765 - protein, 209 aa, Homo sapiens; identical to SEQ ID NO: 897761

SEQ ID NO: 897766 - protein, 209 aa, Homo sapiens; identical to SEQ ID NO: 897761

SEQ ID NO: 897767 - protein, 173 aa, Homo sapiens
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVRVPSQGAGSRHWALFSLFVCCLCLLFGKQQ

SEQ ID NO: 897768 - protein, 118 aa, Homo sapiens
MVDYSVWDHIEVSDDEDETHPNIDTASLFRWRHQARVERMEQFQKEKEELDRGCRECKRKVAECQRKLKELEVAEGGKAELERLQAEAQQLRKERRQVLGTHYWKAVPKTGDEKDVSV

SEQ ID NO: 897769 - protein, 169 aa, Homo sapiens; identical to SEQ ID NO: 897763

SEQ ID NO: 897770 - protein, 209 aa, Homo sapiens; identical to SEQ ID NO: 897761

SEQ ID NO: 897771 - protein, 209 aa, Homo sapiens; identical to SEQ ID NO: 897761

SEQ ID NO: 897772 - protein, 169 aa, Homo sapiens; identical to SEQ ID NO: 897763

SEQ ID NO: 897773 - protein, 209 aa, Homo sapiens; identical to SEQ ID NO: 897761

SEQ ID NO: 897774 - protein, 209 aa, Homo sapiens; identical to SEQ ID NO: 897761

SEQ ID NO: 897775 - protein, 141 aa, Homo sapiens
ALRSLAPAHSPSHPTTEHGKYQAREDGGGLRGGEGAETQDLRGTNTRNRSSTLVSGACGLWGARSRQALCLQGPPAPCQHLPTGMLRRWDDSQKYLSDNVHLVCEETANYLVIWCIDLEVEEVSGAFPGTVKRRCHEAATW

SEQ ID NO: 897776 - protein, 349 aa, Homo sapiens
MEDPQSKEPAGEAVAPALLESPRPEGGEEPPRPSPEETQQCKFDGQETKGSKFITSSASDFSDPVYKEIAITNGCINRMSKEELRAKLSEFKLETRGVKDVLKKRLKNYYKKQKLMLKESNFADSYYDYICIIDFEATCEEGNPPEFVHEIIEFPVVLLNTHTLEIEDTFQQYVRPEINTQLSDFCISLTGITQDQVDRADTFPQVLKKVIDWMKLKELGTKYKYSLLTDGSWDMSKFLNIQCQLSRLKYPPFAKKWINIRKSYGNFYKVPRSQTKLTIMLEKLGMDYDGRPHCGLDDSKNIARIAVRMLQDGCELRINEKMHAGQLMSVSSSLPIEGTPPPQMPHFRK

SEQ ID NO: 897777 - protein, 82 aa, Homo sapiens
MYLSVFKAIKIHWAFCHHVKMDTAWYALITFPFLILTVIAVFALAVLFYTQKSGKVLNSILPPKQNKIHGLGYNSEVFSTYF

SEQ ID NO: 897778 - protein, 103 aa, Homo sapiens
KRVIGKILPSEKAVVTEPAKGEEAFQMSEVDEESGLKDSEPERKRKKTEDSSSGKSVASDVPEGEKAMTNHCKSTRHKQNTEKFMAKQRKEKEQNEAEERSSR

SEQ ID NO: 897779 - protein, 349 aa, Homo sapiens; identical to SEQ ID NO: 897776

SEQ ID NO: 897780 - protein, 234 aa, Homo sapiens
MLKESNFADSYYDYICIIDFEATCEEGNPPEFVHEIIEFPVVLLNTHTLEIEDTFQQYVRPEINTQLSDFCISLTGITQDQVDRADTFPQVLKKVIDWMKLKELGTKYKYSLLTDGSWDMSKFLNIQCQLSRLKYPPFAKKWINIRKSYGNFYKVPRSQTKLTIMLEKLGMDYDGRPHCGLDDSKNIARIAVRMLQDGCELRINEKMHAGQLMSVSSSLPIEGTPPPQMPHFRK

SEQ ID NO: 897781 - protein, 304 aa, Homo sapiens
MEDPQSKEPAGEAVAPALLESPRPEGGEEPPRPSPEETQQCKFDGQETKGSKFITSSASDFSDPVYKEIAITNGCINRMSKEELRAKLSEFKLETRGVKDVLKKRLKNYYKKQKLMLKESNFADSYYDYICIIDFEATCEEGNPPEFVHEIIEFPVVLLNTHTLEIEDTFQQYVRPEINTQLSDFCISLTGITQDQVDRADTFPQVLKKVIDWMKLKELGTKYKYSLLTDGSWDMSKFLNIQCQLSRLKYPPFAKKWINIRKSYGNFYKRKRKGPGVATGKPQLVWEGNLTCDASGRLCKLLGD

SEQ ID NO: 897782 - protein, 124 aa, Homo sapiens
KRVIGKILPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 897783 - protein, 154 aa, Homo sapiens
MEDPQSKEPAGEAVAPALLESPRPEGGEEPPRPSPEETQQCKFDGQETKEIAITNGCINRMSKEELRAKLSEFKLETRGVKDVLKKRLKNYYKKQKLMLKESNFADSYYDYICIIDFEATCEEGNPPEFVHEIIEFPVVLLNTHTLEIVSEFLY

SEQ ID NO: 897784 - protein, 298 aa, Homo sapiens
MEDPQSKEPAGEAVAPALLESPRPEGGEEPPRPSPEETQQCKFDGQETKGSKFITSSASDFSDPVYKEIAITNGCINRMSKEELRAKLSEFKLETRGVKDVLKKRLKNYYKKQKLMLKESNFADSYYDYICIIDFEATCEEGNPPEFVHEIIEFPVVLLNTHTLEIEDTFQQYVRPEINTQLSDFCISLTGITQDQVDRADTFPQVLKKVIDWMKLKELGTKYKYSLLTDGSWDMSKFLNIQCQLSRLKYPPFAKKWINIRKSYGNFYKGEHPHPRDACSPGGSRGRESCGCGRYAFV

SEQ ID NO: 897785 - protein, 111 aa, Homo sapiens
AGEAVAPALLESPRPEGGEEPPRPSPEVRSRPAPGCWRQLPRPQSALGTPFFSGVPQKVQLCALGPQPLPRCPAPWLYPRVGVLEPPQGRITLWEGGNRQDQFCLQWVNRF

SEQ ID NO: 897786 - protein, 957 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 897787 - protein, 342 aa, Homo sapiens [sequence omitted]

SEQ ID NO: 897788 - protein, 840 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRDHGKPGIQGQPGPPGICDPSLCFSVIARRDPFRKGPNY

SEQ ID NO: 897789 - protein, 957 aa, Homo sapiens; identical to SEQ ID NO: 897786

SEQ ID NO: 897790 - protein, 701 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKVCIG

SEQ ID NO: 897791 - protein, 957 aa, Homo sapiens; identical to SEQ ID NO: 897786

SEQ ID NO: 897792 - protein, 355 aa, Homo sapiens
MEGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 897793 - protein, 540 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGYQGIAGTPGVPGSPGIQGARGLPGYKGEPGRDGDKGDRGLPGFPGLHGMPGSKGEMGAKGDKGSPGFYGKKGSIDHTTKYSY

SEQ ID NO: 897794 - protein, 669 aa, Homo sapiens
TTTPAPEPAAVPAAEELCLPLHLTRARRPAACAPAQPASPPGARPVAALHARGEPSALAGTEGPAAVMLSAIYTVLAGLLFLPLLVNLCCPYFFQDIGYFLKVAAVGRRVRSYGQRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKASYARPRFLRIQDTIEITGTFKHRKMTLVEEGFNPAVIKDALYFLDDTAKMYVPMTEDIYNAISAKTLKL

SEQ ID NO: 897795 - protein, 687 aa, Homo sapiens
TTTPAPEPAAVPAAEELCLPLHLTRARRPAACAPAQPASPPGARPVAALHARGEPSALAGTEGPAAVMLSAIYTVLAGLLFLPLLVNLCCPYFFQDIGYFLKVAAVGRRVRSYGQRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 897796 - protein, 118 aa, Homo sapiens
VNRSPYIPGLLSPLGTSSLLPCRQACRACLWPREGRGPRICVHRHLGEEKEQETTPHRVKQETTTTSCKNPAKKTKESQSAACQRGRKNARMENLNASKQKGILDRGCFSLSKNLKRT

SEQ ID NO: 897797 - protein, 328 aa, Homo sapiens
LRCRAGEPRLGPEWGARRGGATRRGWRRDQKPLPQAEPTSAGTRAQGRGGGGGDCSGWTMAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 897798 - protein, 261 aa, Homo sapiens
LRCRAGEPRLGPEWGARRGGATRRGWRRDQKPLPQAEPTSAGTRAQGRGGGGGDCSGWTMAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTG

SEQ ID NO: 897799 - protein, 268 aa, Homo sapiens
LRCRAGEPRLGPEWGARRGGATRRGWRRDQKPLPQAEPTSAGTRAQGRGGGGGDCSGWTMAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 897800 - protein, 328 aa, Homo sapiens; identical to SEQ ID NO: 897797

SEQ ID NO: 897801 - protein, 74 aa, Homo sapiens
SLGGLGILLILSDIRITPQAPRKSPSDTEGLVKSLPSGSHQGPVIYAQLDHSGGHHSDKINKSESVVYADIRKN

SEQ ID NO: 897802 - protein, 178 aa, Homo sapiens
LRCRAGEPRLGPEWGARRGGATRRGWRRDQKPLPQAEPTSAGTRAQGRGGGGGDCSGWTMAASAGAGAVIAAPDSRRWLWSVLAAALGLLTAGVSALEVYTPKEIFVANGTQGKLTCKFKSTSTTGGLTSVSWSFQPEGADTTVSGPVIYAQLDHSGGHHSDKINKSESVVYADIRKN

SEQ ID NO: 897803 - protein, 328 aa, Homo sapiens; identical to SEQ ID NO: 897797

SEQ ID NO: 897804 - protein, 328 aa, Homo sapiens; identical to SEQ ID NO: 897797

SEQ ID NO: 897805 - protein, 328 aa, Homo sapiens; identical to SEQ ID NO: 897797

SEQ ID NO: 897806 - protein, 188 aa, Homo sapiens
LRCRAGEPRLGPEWGARRGGATRRGWRRDQKPLPQAEPTSAGTRAQGRGGGGGDCSGWTMAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINTGSSYQDD

SEQ ID NO: 897807 - protein, 328 aa, Homo sapiens; identical to SEQ ID NO: 897797

SEQ ID NO: 897808 - protein, 328 aa, Homo sapiens; identical to SEQ ID NO: 897797

SEQ ID NO: 897809 - protein, 328 aa, Homo sapiens; identical to SEQ ID NO: 897797

SEQ ID NO: 897810 - protein, 328 aa, Homo sapiens; identical to SEQ ID NO: 897797

SEQ ID NO: 897811 - protein, 328 aa, Homo sapiens; identical to SEQ ID NO: 897797

SEQ ID NO: 897812 - protein, 328 aa, Homo sapiens; identical to SEQ ID NO: 897797

SEQ ID NO: 897813 - protein, 328 aa, Homo sapiens; identical to SEQ ID NO: 897797

SEQ ID NO: 897814 - protein, 145 aa, Homo sapiens
MQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 897815 - protein, 558 aa, Homo sapiens
MSRTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 897816 - protein, 384 aa, Homo sapiens
MVPDSGQWISWDQSPMSRITVPHGDRPQTHLSGPADFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 897817 - protein, 105 aa, Homo sapiens
IHNGFILGKIQLPRPKMAPANDTYESIFSHFREYEIAIRKVPGNFTVWGSPRPQGQNSLGFPVPWAGSTLVCHWELCLWTKGRVWDGGWAEEGVETTSALRAMLL

SEQ ID NO: 897818 - protein, 603 aa, Homo sapiens
QSQPKGSWRRAGRLRSGPGRCGAPRMLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 897819 - protein, 395 aa, Homo sapiens
QSQPKGSWRRAGRLRSGPGRCGAPRMLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTSPHRASGAGSLSLEDLKVYIFWTLKHIIMDSLRGDKGSRDPGWGFQLRTHPSGGYLWHPSANISLSPTNGVASPWGTC

SEQ ID NO: 897820 - protein, 365 aa, Homo sapiens
KEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 897821 - protein, 466 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 897822 - protein, 446 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 897823 - protein, 418 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKGANQLMRKALLSLFMSLKQLQHSFPLFLYVFNLSKFFT

SEQ ID NO: 897824 - protein, 466 aa, Homo sapiens; identical to SEQ ID NO: 897821

SEQ ID NO: 897825 - protein, 245 aa, Homo sapiens
LTTLSCISENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLRDYHTCLTYPTVLLRKSD

SEQ ID NO: 897826 - protein, 466 aa, Homo sapiens; identical to SEQ ID NO: 897821

SEQ ID NO: 897827 - protein, 466 aa, Homo sapiens; identical to SEQ ID NO: 897821

SEQ ID NO: 897828 - protein, 81 aa, Homo sapiens
VSLSLSLSLSLSLSLEKLKEKKLTPITYPQGLAMAKEIGAVKYLECSALTQRGLKTVFDEAIRAVLCPPPVKKRKRKCLLL

SEQ ID NO: 897829 - protein, 192 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897830 - protein, 192 aa, Homo sapiens; identical to SEQ ID NO: 897829

SEQ ID NO: 897831 - protein, 192 aa, Homo sapiens; identical to SEQ ID NO: 897829

SEQ ID NO: 897832 - protein, 192 aa, Homo sapiens; identical to SEQ ID NO: 897829

SEQ ID NO: 897833 - protein, 192 aa, Homo sapiens; identical to SEQ ID NO: 897829

SEQ ID NO: 897834 - protein, 192 aa, Homo sapiens; identical to SEQ ID NO: 897829

SEQ ID NO: 897835 - protein, 192 aa, Homo sapiens; identical to SEQ ID NO: 897829

SEQ ID NO: 897836 - protein, 225 aa, Homo sapiens
MQAIKCVVVGDGAVGKTCLLISYTTNAFPGEYIPTVLSLLPRMECCDAISAHCSVCLLGSSDSLPQPPSFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897837 - protein, 192 aa, Homo sapiens; identical to SEQ ID NO: 897829

SEQ ID NO: 897838 - protein, 192 aa, Homo sapiens; identical to SEQ ID NO: 897829

SEQ ID NO: 897839 - protein, 178 aa, Homo sapiens
RYYLLLLNSRPRRHGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897840 - protein, 173 aa, Homo sapiens
KQRLKACALPATLTYYARRGWHPMKHLLGSGGGTALQTCCAEPGPTQRWPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897841 - protein, 192 aa, Homo sapiens; identical to SEQ ID NO: 897829

SEQ ID NO: 897842 - protein, 167 aa, Homo sapiens
ISHNTDPARYSESTSATRQQMKGEDAQPQEMASTSFPRASGPSPEFRQHGDSDGKRGSPQNLPIEHHFACKECVGITSDVTNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897843 - protein, 155 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIVAVKYL

SEQ ID NO: 897844 - protein, 192 aa, Homo sapiens; identical to SEQ ID NO: 897829

SEQ ID NO: 897845 - protein, 192 aa, Homo sapiens; identical to SEQ ID NO: 897829

SEQ ID NO: 897846 - protein, 192 aa, Homo sapiens; identical to SEQ ID NO: 897829

SEQ ID NO: 897847 - protein, 192 aa, Homo sapiens; identical to SEQ ID NO: 897829

SEQ ID NO: 897848 - protein, 192 aa, Homo sapiens; identical to SEQ ID NO: 897829

SEQ ID NO: 897849 - protein, 187 aa, Homo sapiens
MLEEGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897850 - protein, 211 aa, Homo sapiens
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897851 - protein, 157 aa, Homo sapiens
VWSVGVWSVLVLCSVWSCGGVWSCGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897852 - protein, 167 aa, Homo sapiens
MVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 897853 - protein, 288 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGMESCVFPPPCTSFIVVTETGVQSGKGGCVSPTQGLVYSWGTSWQGPVGLNVSVGRWKQGWEPAEGARAPGAASRWWCDQKRVGSSVHCRVVVFPVGAVKYLECSALTQRGLKTVFDEAIRAVLCPPPVKKRKRKCLLL

SEQ ID NO: 897854 - protein, 68 aa, Homo sapiens
AAAYYYYYCSEFKLLTMYGDMAKEIGAVKYLECSALTQRGLKTVFDEAIRAVLCPPPVKKRKRKCLLL

SEQ ID NO: 897855 - protein, 123 aa, Homo sapiens
LRERRGRERRGRERPRPEPGSGGAGAGEGRPDVSGAAISCFSAVFLSFGWWPLPGIGFQSAEGEAAWTAAPAPSAPPPASRAPVRRAPSPPLPISAPCRRRRGPASGPDAGHQVCGGGRRSCR

SEQ ID NO: 897856 - protein, 375 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 897857 - protein, 386 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 897858 - protein, 214 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYECRCIGEEKEMWNFGEKYARF

SEQ ID NO: 897859 - protein, 112 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQGNCIFLNIK

SEQ ID NO: 897860 - protein, 286 aa, Homo sapiens
MKVKHENELCVKFLFDIQRIVCKPKLLIVSDFRDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 897861 - protein, 246 aa, Homo sapiens
MATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 897862 - protein, 286 aa, Homo sapiens; identical to SEQ ID NO: 897860

SEQ ID NO: 897863 - protein, 246 aa, Homo sapiens; identical to SEQ ID NO: 897861

SEQ ID NO: 897864 - protein, 157 aa, Homo sapiens [sequence omitted]

SEQ ID NO: 897865 - protein, 375 aa, Homo sapiens; identical to SEQ ID NO: 897856

SEQ ID NO: 897866 - protein, 214 aa, Homo sapiens; identical to SEQ ID NO: 897858

SEQ ID NO: 897867 - protein, 112 aa, Homo sapiens; identical to SEQ ID NO: 897859

SEQ ID NO: 897868 - protein, 161 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQVLVHLHMDSHKLNGVMSGQPKLLAFEKTVKYFNIKLLQCKIISMSLLVISAQKLQLKI

SEQ ID NO: 897869 - protein, 67 aa, Homo sapiens
MGKEVKVNWATTPSSQKKDTSNHFHVFVGDLSPEITTEDIKAAFAPFGRISDAVVKDMAGLDWLCSF

SEQ ID NO: 897870 - protein, 375 aa, Homo sapiens; identical to SEQ ID NO: 897856

SEQ ID NO: 897871 - protein, 214 aa, Homo sapiens; identical to SEQ ID NO: 897858

SEQ ID NO: 897872 - protein, 285 aa, Homo sapiens
MQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 897873 - protein, 214 aa, Homo sapiens; identical to SEQ ID NO: 897858

SEQ ID NO: 897874 - protein, 275 aa, Homo sapiens
MTDIVCTTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 897875 - protein, 220 aa, Homo sapiens [sequence omitted]

SEQ ID NO: 897876 - protein, 308 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSSSTVVSTQRSQDHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQFQNGVSWIAVVT

SEQ ID NO: 897877 - protein, 214 aa, Homo sapiens; identical to SEQ ID NO: 897858

SEQ ID NO: 897878 - protein, 214 aa, Homo sapiens; identical to SEQ ID NO: 897858

SEQ ID NO: 897879 - protein, 160 aa, Homo sapiens
MEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWVSSVRSAWIMLKE

SEQ ID NO: 897880 - protein, 226 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 897881 - protein, 226 aa, Homo sapiens; identical to SEQ ID NO: 897880

SEQ ID NO: 897882 - protein, 208 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEMVEG

SEQ ID NO: 897883 - protein, 193 aa, Homo sapiens
MEGCVSNLMVCNLAYSGKLEELKESILADKSLATRTDQAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 897884 - protein, 185 aa, Homo sapiens
MEGCVSNLMVCNLAYSGKLEELKESILADKSLATRTDQDSRTALHWACSAGHTEIVEFLLQLGVPVNDKDDAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 897885 - protein, 226 aa, Homo sapiens; identical to SEQ ID NO: 897880

SEQ ID NO: 897886 - protein, 151 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKDT

SEQ ID NO: 897887 - protein, 246 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVLGKKIWGAPPFWGGLPPPKKNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 897888 - protein, 709 aa, Homo sapiens
KSSLSLLGHRLVSVTEYFVRLPPPSQILITEFQGEGTCEMGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 897889 - protein, 709 aa, Homo sapiens; identical to SEQ ID NO: 897888

SEQ ID NO: 897890 - protein, 709 aa, Homo sapiens; identical to SEQ ID NO: 897888

SEQ ID NO: 897891 - protein, 279 aa, Homo sapiens
MVLTCMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 897892 - protein, 612 aa, Homo sapiens
KSSLSLLGHRLVSVTEYFVRLPPPSQILITEFQGEGTCEMGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRR

SEQ ID NO: 897893 - protein, 274 aa, Homo sapiens
KSSLSLLGHRLVSVTEYFVRLPPPSQILITEFQGEGTCEMGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGCQHHP

SEQ ID NO: 897894 - protein, 479 aa, Homo sapiens
KSSLSLLGHRLVSVTEYFVRLPPPSQILITEFQGEGTCEMGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYR

SEQ ID NO: 897895 - protein, 709 aa, Homo sapiens; identical to SEQ ID NO: 897888

SEQ ID NO: 897896 - protein, 527 aa, Homo sapiens
NSHGWLVRTCMGWASPELAWLVQTEPAWLVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 897897 - protein, 274 aa, Homo sapiens; identical to SEQ ID NO: 897893

SEQ ID NO: 897898 - protein, 645 aa, Homo sapiens
KSSLSLLGHRLVSVTEYFVRLPPPSQILITEFQGEGTCEMGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININGKLKF

SEQ ID NO: 897899 - protein, 92 aa, Homo sapiens
EHPKLDAMKIPVLPAVVLLSLLVLHSAQGATLGGPEEESTIENYASRPEAFKADEFLNWHALFESIKRKLPFLNWDAFPKLKGLRSATPDAQ

SEQ ID NO: 897900 - protein, 106 aa, Homo sapiens
EHPKLDAMKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 897901 - protein, 497 aa, Homo sapiens
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 897902 - protein, 423 aa, Homo sapiens
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATYVFWLIEALGKIVTG

SEQ ID NO: 897903 - protein, 222 aa, Homo sapiens
MDVPGPVSRRAAAAAATVLLRTARVRRECWFLPTALLCAYGFFASLRPSEPFLTPYLLGPDKNLTEREEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATYVFWLIEALGKIVTG

SEQ ID NO: 897904 - protein, 423 aa, Homo sapiens; identical to SEQ ID NO: 897902

SEQ ID NO: 897905 - protein, 497 aa, Homo sapiens; identical to SEQ ID NO: 897901

SEQ ID NO: 897906 - protein, 227 aa, Homo sapiens
MVVPLPVAGLVARVLLLLSLFLPRAGLCRRALPVYFGEARALGGFTERPEGDFSAPRTLRGGVTPMTPPSFIVPPGPLIFSWEVGVPTCGAPPPRVGSSLPRVCPPGALFPPPPVCCINAARRLPLALLLTRPPSWGPPLLKKTGWAVMGAPPGGDFLAGAPLFFFFFFFFFFFFFFFFFLMECGTNCSCYQSNISLEFNSKFVAYNLSLFLYKTRICSHLGMWPYL

SEQ ID NO: 897907 - protein, 423 aa, Homo sapiens; identical to SEQ ID NO: 897902

SEQ ID NO: 897908 - protein, 423 aa, Homo sapiens; identical to SEQ ID NO: 897902

SEQ ID NO: 897909 - protein, 264 aa, Homo sapiens
MSWGKDNKSTWIQNILLLLESKNAFKNATDRPGVSHCARPQNQLSQDDKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 897910 - protein, 459 aa, Homo sapiens
PQEADINLPGRKFRSLQTLGEATRQRTKMAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLIACSQCMRKVGLWGFQQIESSMTDLDASFGLTSSPIPGLEGRPERLPLVPESPRRMMTRSQDATFSPGSEQDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 897911 - protein, 324 aa, Homo sapiens
PQEADINLPGRKFRSLQTLGEATRQRTKMAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACRLKRALVPLSLELGAGTLPVLLTVLSQRLLAPPPELAQ

SEQ ID NO: 897912 - protein, 435 aa, Homo sapiens [sequence omitted]

SEQ ID NO: 897913 - protein, 370 aa, Homo sapiens
MWISDKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLIACSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 897914 - protein, 287 aa, Homo sapiens
PQEADINLPGRKFRSLQTLGEATRQRTKMAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACR

SEQ ID NO: 897915 - protein, 208 aa, Homo sapiens
PQEADINLPGRKFRSLQTLGEATRQRTKMAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPGTWNSMCIKLNSSSYT

SEQ ID NO: 897916 - protein, 530 aa, Homo sapiens
PQEADINLPGRKFRSLQTLGEATRQRTKMAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLIACSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 897917 - protein, 481 aa, Homo sapiens [sequence omitted]

SEQ ID NO: 897918 - protein, 378 aa, Homo sapiens
MRGLPRKREAWTHKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLIACSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 897919 - protein, 334 aa, Homo sapiens
MLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLIACSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 897920 - protein, 245 aa, Homo sapiens
PQEADINLPGRKFRSLQTLGEATRQRTKMAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDGVSLLLPRLEYSGAILAHCNLRLPRSSNSPASASRVARITGVRHHAQLILYF

SEQ ID NO: 897921 - protein, 190 aa, Homo sapiens
MRGLPRKREAWTQPHPLEALYESLRVLEKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMVSFS

SEQ ID NO: 897922 - protein, 346 aa, Homo sapiens
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 897923 - protein, 346 aa, Homo sapiens; identical to SEQ ID NO: 897922

SEQ ID NO: 897924 - protein, 272 aa, Homo sapiens
FVTRLIYRQVEALPLQATSALVVICSRKGPRLWVAYSSRHDPRLWVRYNVPVTGHLWVRVVHITDRLLGRVIMVHVSGQLLGMRGSTSRPLSLSRKVVPSQPPSASWVCVVLPQPPEVAGGVLRLSSKGESGPADARQGVLILSSAEGGAEGRGVSCRSEGVLRLSSAEGESSCRIRHEEQCEERIEEVTKKGNEAVASRDLSENNDQRQQHLAGALAPLASHRLPSSWDYRHTVTEAGPVCNSRCHLQLKHSSYVMSLVTKVKLSHPEKAT

SEQ ID NO: 897925 - protein, 347 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQSCPVSEPGKSRDGGP

SEQ ID NO: 897926 - protein, 467 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 897927 - protein, 467 aa, Homo sapiens; identical to SEQ ID NO: 897926

SEQ ID NO: 897928 - protein, 445 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDDLP

SEQ ID NO: 897929 - protein, 467 aa, Homo sapiens; identical to SEQ ID NO: 897926

SEQ ID NO: 897930 - protein, 460 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDGSWEVPLKTGKILHVAFD

SEQ ID NO: 897931 - protein, 414 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGGCEVSGAAV

SEQ ID NO: 897932 - protein, 322 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSTTSNLNILHM

SEQ ID NO: 897933 - protein, 467 aa, Homo sapiens; identical to SEQ ID NO: 897926

SEQ ID NO: 897934 - protein, 400 aa, Homo sapiens [sequence omitted]

SEQ ID NO: 897935 - protein, 171 aa, Homo sapiens
FFFFFFFKSNAGKVTANCVLCTEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 897936 - protein, 467 aa, Homo sapiens; identical to SEQ ID NO: 897926

SEQ ID NO: 897937 - protein, 467 aa, Homo sapiens; identical to SEQ ID NO: 897926

SEQ ID NO: 897938 - protein, 450 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDGHMSEGDN

SEQ ID NO: 897939 - protein, 413 aa, Homo sapiens
GGGALPLRRPETRRRWTRRRWAHGAEPAGARGRRRRESDPGGLVAGPRIPEWRPEPRKEILSADFEMMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGTGGKMRQR

SEQ ID NO: 897940 - protein, 980 aa, Homo sapiens
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 897941 - protein, 149 aa, Homo sapiens
DRPRHPQVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 897942 - protein, 785 aa, Homo sapiens
VIFIADSRGYTEGQRTVTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 897943 - protein, 180 aa, Homo sapiens
MENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 897944 - protein, 229 aa, Homo sapiens [sequence omitted]

SEQ ID NO: 897945 - protein, 214 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFAGQFLEELLFHLEALSG

SEQ ID NO: 897946 - protein, 190 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGGCPAGR

SEQ ID NO: 897947 - protein, 136 aa, Homo sapiens
MASLSRPSLPSCLCSFLLLLLLQVSSSYADPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELLFHLEALSG

SEQ ID NO: 897948 - protein, 252 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELLFHLEALSG

SEQ ID NO: 897949 - protein, 147 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEGE

SEQ ID NO: 897950 - protein, 250 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLSSTWKPSLAKDRQVPLSPSEDTCTGEQHRMVSAMNWRPGISSLKITVW

SEQ ID NO: 897951 - protein, 145 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPLHLLCWCAVTIPWTPSCRLFII

SEQ ID NO: 897952 - protein, 308 aa, Homo sapiens
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 897953 - protein, 357 aa, Homo sapiens
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPEKSSDCRPSACTVKTGLDPTLVGICGEGTESVQSLLLGAVPKGNATKEYMESLQLKPGEVIYKCPKCCCIKPERAHHCRAWNTEKSNSPFHICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 897954 - protein, 191 aa, Homo sapiens
MESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 897955 - protein, 345 aa, Homo sapiens
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPEKSSDCRPSACTVKTGLDPTLVGICGEGTESVQSLLLGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 897956 - protein, 345 aa, Homo sapiens; identical to SEQ ID NO: 897955

SEQ ID NO: 897957 - protein, 126 aa, Homo sapiens [sequence omitted]

SEQ ID NO: 897958 - protein, 308 aa, Homo sapiens; identical to SEQ ID NO: 897952

SEQ ID NO: 897959 - protein, 345 aa, Homo sapiens; identical to SEQ ID NO: 897955

SEQ ID NO: 897960 - protein, 191 aa, Homo sapiens; identical to SEQ ID NO: 897954

SEQ ID NO: 897961 - protein, 345 aa, Homo sapiens; identical to SEQ ID NO: 897955

SEQ ID NO: 897962 - protein, 146 aa, Homo sapiens [sequence omitted]

SEQ ID NO: 897963 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 897964 - protein, 375 aa, Homo sapiens
MCPEATQGISQRLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 897965 - protein, 414 aa, Homo sapiens
QEGGTKGAAGPRMGLGQGWGWEASCFACLIRSCCQVVTFTFPFGFQGISQRLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 897966 - protein, 331 aa, Homo sapiens; identical to SEQ ID NO: 897963

SEQ ID NO: 897967 - protein, 331 aa, Homo sapiens; identical to SEQ ID NO: 897963

SEQ ID NO: 897968 - protein, 331 aa, Homo sapiens; identical to SEQ ID NO: 897963

SEQ ID NO: 897969 - protein, 331 aa, Homo sapiens; identical to SEQ ID NO: 897963

SEQ ID NO: 897970 - protein, 202 aa, Homo sapiens
MSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 897971 - protein, 331 aa, Homo sapiens; identical to SEQ ID NO: 897963

SEQ ID NO: 897972 - protein, 331 aa, Homo sapiens; identical to SEQ ID NO: 897963

SEQ ID NO: 897973 - protein, 331 aa, Homo sapiens; identical to SEQ ID NO: 897963

SEQ ID NO: 897974 - protein, 212 aa, Homo sapiens
MMGRPCLLTAGRPCLWRRMAPSLQTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 897975 - protein, 212 aa, Homo sapiens; identical to SEQ ID NO: 897974

SEQ ID NO: 897976 - protein, 212 aa, Homo sapiens; identical to SEQ ID NO: 897974

SEQ ID NO: 897977 - protein, 212 aa, Homo sapiens; identical to SEQ ID NO: 897974

SEQ ID NO: 897978 - protein, 220 aa, Homo sapiens
MMGRPCLLTAGRPCLWRRMAPSLQTPVQYLLPEAKAQDSDKICVVIDLDETLVHSSFKPVNNADFIIPVEIDGVVHQPPHWPAPQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 897979 - protein, 140 aa, Homo sapiens
MMGRPCLLTAGRPCLWRRMAPSLQTPVQYLLPEAKAQDSDKICVVIDLDETLVHSSFKPVNNADFIIPVEIDGVVHQLRRVLILDNSPASYVFHPDNAVPVASWFDNMSDTELHDLLPFFEQLSRVDDVYSVLRQPRPGS

SEQ ID NO: 897980 - protein, 212 aa, Homo sapiens; identical to SEQ ID NO: 897974

SEQ ID NO: 897981 - protein, 212 aa, Homo sapiens; identical to SEQ ID NO: 897974

SEQ ID NO: 897982 - protein, 212 aa, Homo sapiens; identical to SEQ ID NO: 897974

SEQ ID NO: 897983 - protein, 212 aa, Homo sapiens; identical to SEQ ID NO: 897974

SEQ ID NO: 897984 - protein, 212 aa, Homo sapiens; identical to SEQ ID NO: 897974

SEQ ID NO: 897985 - protein, 212 aa, Homo sapiens; identical to SEQ ID NO: 897974

SEQ ID NO: 897986 - protein, 88 aa, Homo sapiens
LLVCSSFPSLVLRLCAVACRFFFRLSFCLRRFLSPLSSLPSILLPVTHTLCLSLSLCSSAPRLASPFLSFSPPARPRGVSFFFFFLYI

SEQ ID NO: 897987 - protein, 212 aa, Homo sapiens; identical to SEQ ID NO: 897974

SEQ ID NO: 897988 - protein, 233 aa, Homo sapiens
MARLRLHSISPCQQGQGSPCDVHSPWYTACLHVVSQCDIMSPNVVLPLLQPDDSTQNAPNGAICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVPVASWFDNMSDTELHDLLPFFEQLSRVDDVYSVLRQPRPGS

SEQ ID NO: 897989 - protein, 212 aa, Homo sapiens; identical to SEQ ID NO: 897974

SEQ ID NO: 897990 - protein, 146 aa, Homo sapiens
MLPCFSAAKLGPLAPSGSASWGQGSCLGPPVWERWTSSALHRAPSSPPSFPRGTALGWEGRTSPSPCPTSSLGTERAPTNLCLCLGGRGGLLPLGKAAGVCPSGPTVQLLQGRQLRAAPCIIQAMTSDFCLNQPRGLAPPALSVGA

SEQ ID NO: 897991 - protein, 212 aa, Homo sapiens; identical to SEQ ID NO: 897974

SEQ ID NO: 897992 - protein, 212 aa, Homo sapiens; identical to SEQ ID NO: 897974

SEQ ID NO: 897993 - protein, 212 aa, Homo sapiens; identical to SEQ ID NO: 897974

SEQ ID NO: 897994 - protein, 209 aa, Homo sapiens
MAPSLQTPVQYLLPEAKAQDSDKICVVIDLDETLVHSSFKPVNNADFIIPVEIDGVVHQVYVLKRPHVDEFLQRMGELFECVLFTASLAKYADPVADLLDKWGAFRARLFRESCVFHRGNYVKDLSRLGRDLRRVLILDNSPASYVFHPDNAVSAGWTGTGTGAETQEGVSPFRPPWPLGSPVGGWVPSQSFLHSLPVPAAHSPHPPAL

SEQ ID NO: 897995 - protein, 105 aa, Homo sapiens
MNGGGSGPASQVAADVLNISIKISLFPYARGATELHPYGSYHAVMEAAIHWGALAIELARSGSLCQLWNNNLQLISIDDTLPLGLGQIATEYLLQITLHVFSLER

SEQ ID NO: 897996 - protein, 73 aa, Homo sapiens
RRRSEWKWAADRAAIVSRWNWLQAHVSDLEYRIRQQTDIYKQIRANKVRDKYLMFLNAAENYQYRWSQTLDLK

SEQ ID NO: 897997 - protein, 73 aa, Homo sapiens; identical to SEQ ID NO: 897996

SEQ ID NO: 897998 - protein, 109 aa, Homo sapiens
RRRSEWKWAADRAAIVSRWNWLQAHVSDLEYRIRQQTDIYKQIRANKGLIVLGEVPPPEHTTDLFLPLSSEVKTDHGTDKLIESVSQPLENHGAPIIGHISESLSTKSC

SEQ ID NO: 897999 - protein, 70 aa, Homo sapiens
GVCVRLERTGEPRPAERRGRAVTWTTAQTRASCGSDASGHAGEITLGSSDIQPVSSLLICEHEMGLGCVT

SEQ ID NO: 898000 - protein, 149 aa, Homo sapiens
GGVCEAGADWGAQTCRATWASGDLDHGADAGELRLGRQRTRGRVRGLSVQRARCRHLQRPAVPRRPDLDHFLAASLSGGSPRSGSHFPVQDAGSEATSVVARDPSQDLPGTRRDGTLGPRPQPPAAAGRRDLIPRRPGGTEASRSWEGI

SEQ ID NO: 898001 - protein, 491 aa, Homo sapiens
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 898002 - protein, 491 aa, Homo sapiens; identical to SEQ ID NO: 898001

SEQ ID NO: 898003 - protein, 407 aa, Homo sapiens
MWINRISCARKDVVTTATLPGRVSAPSAGGKSTTKPGRSSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 898004 - protein, 578 aa, Homo sapiens
ASRRVCVGRERTTETRPTAATRASGCVDVGEAAGEGLGNSKTEWPEAWTLSEDISAKAPAAQITLGSSDIQPVSSLLICEHVVSRKKMSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 898005 - protein, 299 aa, Homo sapiens
MQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 898006 - protein, 102 aa, Homo sapiens
MGRSDPDHSPRPRQGRGDLIPRHPRGQKCPGVGRGFEACGPDFHPVAEGEAAGPGLGAEVPASEPSGRRAEGCPSRQFREREGGTLPLWRLGHRQLAVSQRG

SEQ ID NO: 898007 - protein, 68 aa, Homo sapiens
GVCVRLERTGEPRPAERRGRAVTWTTAQTRASCGSDASGHAGEITLGSSDIQPVSSLLICEHGWSAVS

SEQ ID NO: 898008 - protein, 89 aa, Homo sapiens
ASRRVCVGRERTTETRPTAATRASGCVDVGEAAGEGLGNSKTEWPEAWTLSEDISAKAPAAQITLGSSDIQPVSSLLICEHEMGLGCVT

SEQ ID NO: 898009 - protein, 69 aa, Homo sapiens
GVCVRLERTGEPRPAERRGRAVTWTTAQTRASCGSDASGHAGEMFEVRPGMLAHACNPSTFGGQGGRIT

SEQ ID NO: 898010 - protein, 491 aa, Homo sapiens; identical to SEQ ID NO: 898001

SEQ ID NO: 898011 - protein, 491 aa, Homo sapiens; identical to SEQ ID NO: 898001

SEQ ID NO: 898012 - protein, 491 aa, Homo sapiens; identical to SEQ ID NO: 898001

SEQ ID NO: 898013 - protein, 284 aa, Homo sapiens
MDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 898014 - protein, 392 aa, Homo sapiens
RVGTRRCASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 898015 - protein, 89 aa, Homo sapiens; identical to SEQ ID NO: 898008

SEQ ID NO: 898016 - protein, 87 aa, Homo sapiens
ASRRVCVGRERTTETRPTAATRASGCVDVGEAAGEGLGNSKTEWPEAWTLSEDISAKAPAAQITLGSSDIQPVSSLLICEHGWSAVS

SEQ ID NO: 898017 - protein, 727 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898018 - protein, 581 aa, Homo sapiens
MTEEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898019 - protein, 682 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898020 - protein, 753 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELPVDSCLPRSLELHPQKMDPKRQHIQLLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898021 - protein, 791 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKEVRIWWEAFSPSPGVSCSGPYLLTKAFAFTEPILRLFLSSLLTAACPAHSSFTLRRWILKRQHIQLLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898022 - protein, 429 aa, Homo sapiens
SRCKPEASLVTFTPAVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898023 - protein, 727 aa, Homo sapiens; identical to SEQ ID NO: 898017

SEQ ID NO: 898024 - protein, 454 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKEVRIWWEAFSPSPGVSCSGPYLLTKALPSQSPF

SEQ ID NO: 898025 - protein, 385 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPCPLPCSPTSSNFPFPIMLGVLVTRLSFSPLSIPPIICRAEHRQLCALGPGNPPST

SEQ ID NO: 898026 - protein, 239 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHGKSFQLPQAQTSSNKFKKGGITDPSAPHCPDFHG

SEQ ID NO: 898027 - protein, 727 aa, Homo sapiens; identical to SEQ ID NO: 898017

SEQ ID NO: 898028 - protein, 669 aa, Homo sapiens
VQLNAAGRIYEVSPGSARVRPTECGNTTLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898029 - protein, 482 aa, Homo sapiens [sequence omitted]

SEQ ID NO: 898030 - protein, 762 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKEEPILRLFLQLPVDSCLPRSLELHPQKMDPKRQHIQLLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 898031 - protein, 611 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQAGWGRHCRSGAPTCSPWCGPACSWPGLTPMPQSASFLPTVPLTLRGLVTVSPVSLRGYRSSSPIP

SEQ ID NO: 898032 - protein, 478 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVRSWEDVAG

SEQ ID NO: 898033 - protein, 404 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDSSNFPFPIMLGVLVTRLSFSPLSIPPIICRAEHRQLCALGPGNPPST

SEQ ID NO: 898034 - protein, 256 aa, Homo sapiens
GGRRAPGARSCEETWQSAAALAPDRKAGEVAEEGGLRAMATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGNPPST

SEQ ID NO: 898035 - protein, 625 aa, Homo sapiens
GRSRPPGGSGRAVAGLRGDRRESAVVRAMEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898036 - protein, 654 aa, Homo sapiens
AGRLGFGIMEAEPPLYPMAGAAGPQGDEDLLGVPDGPEAPVSGDPECEARASLWARSPRRGRGGPGGGGHRGTRVRGAIAGASGVRGSQLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898037 - protein, 514 aa, Homo sapiens [sequence omitted]

SEQ ID NO: 898038 - protein, 534 aa, Homo sapiens
CRAEETVPIYERLTEALISVYHCILLVAETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898039 - protein, 648 aa, Homo sapiens
GRSRPPGGSGRAVAGLRGDRRESAVVRAMEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITSSGCRTHRSGTGRAGESLLSFVVQMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898040 - protein, 292 aa, Homo sapiens
LVQVGDFRMEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898041 - protein, 260 aa, Homo sapiens
PRDAGRAETVVWAVPDFNTQPLVPPQGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898042 - protein, 453 aa, Homo sapiens
GRSRPPGGSGRAVAGLRGDRRESAVVRAMEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALVSTACKGLPDKRQDSQVNLNSSKQRIIFNYICKCVHVYPKYPPPAFSSLSYPRPPFTLGKLF

SEQ ID NO: 898043 - protein, 608 aa, Homo sapiens
QAGTGPEIFGFMEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898044 - protein, 623 aa, Homo sapiens
KTRREVKGLHSLQGWSLVLRAEWEGSHLGGAAGRAFKPEGTQGRESGYFQKWPRGSSQLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898045 - protein, 696 aa, Homo sapiens
GRSRPPGGSGRAVAGLRGDRRESAVVRAMEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRWPGGQQGRRAGDLAKPPLYCQLWLGDHRKPLPPSGPQFPHTGAGLLLALGAGHTGVAQVGLGRAFSPLWSRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898046 - protein, 585 aa, Homo sapiens
MQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITSEPGGQQGRRAGDLAKPPLYCQLWLGDHRKPLPPSGPQFPHTGAGLLLALGAGHTGVAQVGLGRAFSPLWSRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898047 - protein, 290 aa, Homo sapiens
KGLNHEREEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 898048 - protein, 222 aa, Homo sapiens
MAARPKLHYPNGRGRMESVRWVLAAAGVEFDEEFLETKEQLYKLQDGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 898049 - protein, 69 aa, Homo sapiens
LESPLVRSSRSLAQLPRARAACWSHPAGTADLALCAAPGLRVDSRKPEKLSWQQGPSSTIPTEEAGWSP

SEQ ID NO: 898050 - protein, 107 aa, Homo sapiens
MAARPKLHYPNGRGRMESVRWVLAAAGVEFDEEFLETKEQLYKLQDGNHLLFQQVPMVEIDGMKLVQTRSILHYIADKHNLFGKNLKERTLYCGPSRVLSLVSLLMP

SEQ ID NO: 898051 - protein, 129 aa, Homo sapiens
MYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 898052 - protein, 129 aa, Homo sapiens; identical to SEQ ID NO: 898051

SEQ ID NO: 898053 - protein, 177 aa, Homo sapiens
MGFSCRRSRGNHLLFQQVPMVEIDGMKLVQTRSILHYIADKHNLFGIDMYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 898054 - protein, 69 aa, Homo sapiens; identical to SEQ ID NO: 898049

SEQ ID NO: 898055 - protein, 107 aa, Homo sapiens; identical to SEQ ID NO: 898050

SEQ ID NO: 898056 - protein, 231 aa, Homo sapiens
MAARPKLHYPNGRGRMESVRWVLAAAGVEFDEEFLETKEQLYKLQDGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADPAIRRRIADLLRAVHAKTSPVKANYYTQLTNNLTNGTSYPRDNSQSYSRVHINNRVYDLDVGSGHPNGADPAIR

SEQ ID NO: 898057 - protein, 69 aa, Homo sapiens; identical to SEQ ID NO: 898049

SEQ ID NO: 898058 - protein, 222 aa, Homo sapiens; identical to SEQ ID NO: 898048

SEQ ID NO: 898059 - protein, 222 aa, Homo sapiens; identical to SEQ ID NO: 898048

SEQ ID NO: 898060 - protein, 185 aa, Homo sapiens
MGFSCRRSRGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 898061 - protein, 185 aa, Homo sapiens; identical to SEQ ID NO: 898060

SEQ ID NO: 898062 - protein, 69 aa, Homo sapiens; identical to SEQ ID NO: 898049

SEQ ID NO: 898063 - protein, 129 aa, Homo sapiens; identical to SEQ ID NO: 898051

SEQ ID NO: 898064 - protein, 176 aa, Homo sapiens
MAARPKLHYPNGRGRMESVRWVLAAAGVEFDEEFLETKEQLYKLQDGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADVILLQTILALEERIHSETK

SEQ ID NO: 898065 - protein, 107 aa, Homo sapiens; identical to SEQ ID NO: 898050

SEQ ID NO: 898066 - protein, 69 aa, Homo sapiens; identical to SEQ ID NO: 898049

SEQ ID NO: 898067 - protein, 69 aa, Homo sapiens; identical to SEQ ID NO: 898049

SEQ ID NO: 898068 - protein, 428 aa, Homo sapiens
MAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETHHFQRDLANFLKSNSISEELERFTASGIANLRCSEQAFDSDVTDSSSGGESDIEEEELTRADPEQRHVPL

SEQ ID NO: 898069 - protein, 440 aa, Homo sapiens
MAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETHHFQRDLANFLKSNSISEELERFTASGIANLRCSEQAFDSDVTDSSSGGESDIEEEELTRADPEQRHVPLYLHTAKNKERKG

SEQ ID NO: 898070 - protein, 368 aa, Homo sapiens
MAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETHHFQRDLATF

SEQ ID NO: 898071 - protein, 163 aa, Homo sapiens
MTFSYLKIAISRYVTLYLQDLPNTMNAAEITDKLGSIPFRYRNTGHIQATLCHLTGHGLYERPETGSPSQFPEPETGSAGFYSLCLGGHIKLALGCGAVYVCAGTCRQSLKRGLIIAKQTVVHLTDTRARLPPPALKQIGDLSRLSGKLSGLCQDNGSARIPR

SEQ ID NO: 898072 - protein, 323 aa, Homo sapiens
MAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVAQSLLQKSTQLMLYMPLNL

SEQ ID NO: 898073 - protein, 249 aa, Homo sapiens
GVIDATAAMARVVPRTLKRVAAPKHGCWINDRCVAPRPSTGPHKGESVSPSSFSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETHHFQRDLANFLKSNSISEELERFTASGIANLRCSEQAFDSDVTDSSSGGESDIEEEELTRADPEQRHVPL

SEQ ID NO: 898074 - protein, 85 aa, Homo sapiens
GTRFIEPETFLGEVTHPTPISIVRNALSTSMARFWCDRYMLTHLLSEEASCLHEACALLSSQMYLFLFMIRAFRSLKMYIFSYCT

SEQ ID NO: 898075 - protein, 594 aa, Homo sapiens
SPNRLVALLRLRAPLHSRPAMRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 898076 - protein, 594 aa, Homo sapiens; identical to SEQ ID NO: 898075

SEQ ID NO: 898077 - protein, 594 aa, Homo sapiens; identical to SEQ ID NO: 898075

SEQ ID NO: 898078 - protein, 594 aa, Homo sapiens; identical to SEQ ID NO: 898075

SEQ ID NO: 898079 - protein, 176 aa, Homo sapiens
MVAAGGGARTEGAVRRSLWRQCARRVHGEKLRRPTFGPRHRGAGTAKMSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPNIKGTCGCGESFNI

SEQ ID NO: 898080 - protein, 113 aa, Homo sapiens
MRPPCPWREAEAADLRPEAPGRRDGEDVGFLSPGNCPGCEQEEAAAHPGSPHPGECSRRAAGPVTLLVSAPCKGRSRRPGVGPQGRGHVRPRRRSDPPHSLAASFASGPSLQR

SEQ ID NO: 898081 - protein, 133 aa, Homo sapiens
MVAAGGGARTEGAVRRSLWRQCARRVHGEKLRRPTFGPRHRGAGTAKMSASLVRATVRAVSKRKLQPTRAALTLTPSAVNKIKQLLKDKPEHVGVKVGVRTRGCNGLSYTLEYTKTKGDSDEEVIQDGWSAVV

SEQ ID NO: 898082 - protein, 176 aa, Homo sapiens; identical to SEQ ID NO: 898079

SEQ ID NO: 898083 - protein, 176 aa, Homo sapiens; identical to SEQ ID NO: 898079

SEQ ID NO: 898084 - protein, 131 aa, Homo sapiens
MVAAGGGARTEGAVRRSLWRQCARRVHGEKLRRPTFGPRHRGAGTAKMSASLVRATVRAVSKRKLQPTRAALTLTPSAVNKIKQLLKDKPEHVGVKVGVRTRGCNGLSYTLEYTKTKGDSDEEVIQDGIRE

SEQ ID NO: 898085 - protein, 67 aa, Homo sapiens
CVGWGGTRLSEGPLCRGDSVRRGRAQRQQSPRLLPRSRPRRAKRYLPVSWVIEAFETPSVPLASLGS

SEQ ID NO: 898086 - protein, 176 aa, Homo sapiens; identical to SEQ ID NO: 898079

SEQ ID NO: 898087 - protein, 131 aa, Homo sapiens; identical to SEQ ID NO: 898084

SEQ ID NO: 898088 - protein, 176 aa, Homo sapiens; identical to SEQ ID NO: 898079

SEQ ID NO: 898089 - protein, 160 aa, Homo sapiens
MVAAGGGARTEGAVRRSLWRQCARRVHGEKLRRPTFGPRHRGAGTAKMSASLVRATVRAVSKRKLQPTRAALTLTPSAVNKIKQLLKDKPEHVGVKVGVRTRGCNGLSYTLEYTKTKGDSDEEVIQDESHSVARLECSGTISAYRNLRLPGSSDSFVSAS

SEQ ID NO: 898090 - protein, 179 aa, Homo sapiens; identical to SEQ ID NO: 747515

SEQ ID NO: 898091 - protein, 153 aa, Homo sapiens; identical to SEQ ID NO: 747516

SEQ ID NO: 898092 - protein, 179 aa, Homo sapiens; identical to SEQ ID NO: 747515

SEQ ID NO: 898093 - protein, 164 aa, Homo sapiens
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFYQENSSVEDRNYLFLILEL

SEQ ID NO: 898094 - protein, 179 aa, Homo sapiens; identical to SEQ ID NO: 747515

SEQ ID NO: 898095 - protein, 179 aa, Homo sapiens; identical to SEQ ID NO: 747515

SEQ ID NO: 898096 - protein, 179 aa, Homo sapiens; identical to SEQ ID NO: 747515

SEQ ID NO: 898097 - protein, 179 aa, Homo sapiens; identical to SEQ ID NO: 747515

SEQ ID NO: 898098 - protein, 129 aa, Homo sapiens
MLSLDFLDDVRRMNKRQLYYQVLNFGMIVSSALMIWKGLMVITGSESPIVVVLRQNGHIKFLTKGDNNAVDDRGLYKQGQHWLEKKDVVGRARGFVPYIGIVTILMNDYPKFKYAVLFLLGLFVLVHRE

SEQ ID NO: 898099 - protein, 179 aa, Homo sapiens; identical to SEQ ID NO: 747515

SEQ ID NO: 898100 - protein, 179 aa, Homo sapiens; identical to SEQ ID NO: 747515

SEQ ID NO: 898101 - protein, 880 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEPQGSDSSQGDVLRLRVRWWPAASLAVPEAVGRVSLMLQSYSELLFLLEMLLECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898102 - protein, 718 aa, Homo sapiens
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898103 - protein, 718 aa, Homo sapiens; identical to SEQ ID NO: 898102

SEQ ID NO: 898104 - protein, 556 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVILSGPKSGFH

SEQ ID NO: 898105 - protein, 666 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEV

SEQ ID NO: 898106 - protein, 552 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVVSEFQC

SEQ ID NO: 898107 - protein, 386 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQPE

SEQ ID NO: 898108 - protein, 278 aa, Homo sapiens
RWPNGTRCAQWQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898109 - protein, 829 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898110 - protein, 839 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQLFMEPARRENWSAANHQMNSLIWPREQWDSQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898111 - protein, 861 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEPQGSDSSQGDACASGSGGGLRHPLRCQKPWDEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898112 - protein, 705 aa, Homo sapiens
CLSISLRSLSAPAWENTAAVLGLLLSSRRRGPAAPACAVRSVSDGPDPGYRPLARCSPAQTRPWQWRLAIRTDPTWAEVARAPRHEPVTKLGAEREAAVAEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMCA

SEQ ID NO: 898113 - protein, 511 aa, Homo sapiens
TAPATTAPVQQLWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898114 - protein, 431 aa, Homo sapiens
MARYEAVLIGRRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 898115 - protein, 96 aa, Homo sapiens
ICCLSGTIFCWIETANQLQKLEGSSGPVRTSPHSPRPGYGKERAAHQPHDRFTLQLWFVRLALLVKLGLFQNAEMEFEPFGNLDQPDLYYEYYPHV

SEQ ID NO: 898116 - protein, 214 aa, Homo sapiens
MEGSGVFPAEVPGGVAGLWLTGCFLRFFPAQRPLGQRQPRRSFFESFIRTLIITCVALAVVLSSVSICDGHWLLAEDRLFGLWHFCTTTNQSVPICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 898117 - protein, 216 aa, Homo sapiens
DHTRNWRRQWVQMTRPDCSSDFNSRHFPLGQAQRPLGQRQPRRSFFESFIRTLIITCVALAVVLSSVSICDGHWLLAEDRLFGLWHFCTTTNQSVPICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 898118 - protein, 102 aa, Homo sapiens
ARYRLFAWLIARLVAWRLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 898119 - protein, 269 aa, Homo sapiens
MGRTHRERRRRAGGASAPRARPLLQTWVRRRLGGEQPRGACLPHIAAPGARTPAASARGLASTRGSQTSFGKIFLLFGVTSDLLAQRPLGQRQPRRSFFESFIRTLIITCVALAVVLSSVSICDGHWLLAEDRLFGLWHFCTTTNQSVPICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 898120 - protein, 198 aa, Homo sapiens
MVARTQTWTEACWAQRPLGQRQPRRSFFESFIRTLIITCVALAVVLSSVSICDGHWLLAEDRLFGLWHFCTTTNQSVPICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 898121 - protein, 250 aa, Homo sapiens
VPWQVEIRRGDVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 898122 - protein, 57 aa, Homo sapiens
MGIGPGESVSRKLRIKNLRPGVVAHACNPSTLRGRGGQITRSGVRDHLANMVKPHLY

SEQ ID NO: 898123 - protein, 622 aa, Homo sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 898124 - protein, 154 aa, Homo sapiens
MVSSIGVKERKWAQCCCKDEEGPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 898125 - protein, 163 aa, Homo sapiens
GPPTRSHWNSQPLSGPRGAFCSLSGNALAPGQAATPPQRRRGLFFWGVSPARRAPHLACARPEPAVLQAPSILLDAPRTDVGDMGRAMVARLGLGLLLLALLLPTQIYSSETTTGTSSNSSQSTSNTGLAPNPTNATTKAAGGALQSTASLFVVSLSLLHLYS

SEQ ID NO: 898126 - protein, 178 aa, Homo sapiens
MPLLALTMRLLLHIAGLPRRALSHEAYTGVKQPLVQAFLRSRPVSSEAITYIRRPFAVKGGNAPGVLPAFLGGENPTMILGVSHLKVSFLPNSTTRAHKRPPCWDRNAGHTCSLLHTKGPRFLTERNQIGTSCSSSQSTSNTGLAPNPTNATTKAAGGALQSTASLFVVSLSLLHLYS

SEQ ID NO: 898127 - protein, 163 aa, Homo sapiens; identical to SEQ ID NO: 898125

SEQ ID NO: 898128 - protein, 163 aa, Homo sapiens; identical to SEQ ID NO: 898125

SEQ ID NO: 898129 - protein, 163 aa, Homo sapiens; identical to SEQ ID NO: 898125

SEQ ID NO: 898130 - protein, 955 aa, Homo sapiens
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 898131 - protein, 516 aa, Homo sapiens
TPFSSGIYSSIPSIHQIVNIPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 898132 - protein, 444 aa, Homo sapiens
RDKPDVLTHLVGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 898133 - protein, 938 aa, Homo sapiens
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKGKV

SEQ ID NO: 898134 - protein, 955 aa, Homo sapiens; identical to SEQ ID NO: 898130

SEQ ID NO: 898135 - protein, 955 aa, Homo sapiens; identical to SEQ ID NO: 898130

SEQ ID NO: 898136 - protein, 385 aa, Homo sapiens
SRVSTQSGHYGRGTPENSITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 898137 - protein, 468 aa, Homo sapiens
MAQLRRGHLTFRDVAIEFSQEEWKCLDPVQKALYRDVMLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCHECGKTVRDKSGLAEHWRIRTGEKPYKCKECGKLFNRIAYLARHEKVHTGESPYKCNECGKVFSRITYLVRHQKIHTREKPHKCNKCGKVYSSSSYLAQHWRIHTGEKLYKCNKCGKEFSGHSSLTTHLLIHTGEKPYKCKECDKAFRHKFSLTVHQRNHNGEKPYKCHECGKVFTQVSHLARHQKIHTGEKPYKCNECGKVFTQNSHLANHQRIHTGEKPYKCHVCGKVFRHSSWFVQHQRSVHERVLTN

SEQ ID NO: 898138 - protein, 105 aa, Homo sapiens
MAQLRRGHLTFRDVAIEFSQEEWKCLDPVQKALYRDVMLENYRNLVSLGICLPDLSIISMMKQRTEPWTVENEMKVAKNPASCSHQDSVSYNLQRSMYRNPSDGN

SEQ ID NO: 898139 - protein, 105 aa, Homo sapiens
MAQLRRGHLTFRDVAIEFSQEEWKCLDPVQKALYRDVMLENYRNLVSLGICLPDLSIISMMKQRTEPWTVENEMKVAKNPDRWEGIKDINTDGVLFCRPGWSTVV

SEQ ID NO: 898140 - protein, 524 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 898141 - protein, 563 aa, Homo sapiens
PHSGPAAAFIRRRGWWPGPRCAPATPRPLSWLRAPTRLCLDGPSPVLCAGLEHQLTSDHCQPTPSHPRRLHLWAPGIKQVLGCTMISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 898142 - protein, 553 aa, Homo sapiens
PHSGPAAAFIRRRGWWPGPRCAPATPRPLSWLRAPTRLCLDGPSPVLCAEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 898143 - protein, 359 aa, Homo sapiens
PHSGPAAAFIRRRGWWPGPRCAPATPRPLSWLRAPTRLCLDGPSPVLCAGLEHQLTSDHCQPTPSHPRRLHLWAPGIKQVLGCTMISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKCSLPAALWPTG

SEQ ID NO: 898144 - protein, 608 aa, Homo sapiens
PHSGPAAAFIRRRGWWPGPRCAPATPRPLSWLRAPTRLCLDGPSPVLCAGLEHQLTSDHCQPTPSHPRRLHLWAPGIKQVLGCTMISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 898145 - protein, 608 aa, Homo sapiens; identical to SEQ ID NO: 898144

SEQ ID NO: 898146 - protein, 608 aa, Homo sapiens; identical to SEQ ID NO: 898144

SEQ ID NO: 898147 - protein, 608 aa, Homo sapiens; identical to SEQ ID NO: 898144

SEQ ID NO: 898148 - protein, 524 aa, Homo sapiens; identical to SEQ ID NO: 898140

SEQ ID NO: 898149 - protein, 524 aa, Homo sapiens; identical to SEQ ID NO: 898140

SEQ ID NO: 898150 - protein, 170 aa, Homo sapiens [sequence omitted]

SEQ ID NO: 898151 - protein, 310 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 898152 - protein, 310 aa, Homo sapiens; identical to SEQ ID NO: 898151

SEQ ID NO: 898153 - protein, 310 aa, Homo sapiens; identical to SEQ ID NO: 898151

SEQ ID NO: 898154 - protein, 305 aa, Homo sapiens
MLNDSLIPPLQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 898155 - protein, 310 aa, Homo sapiens; identical to SEQ ID NO: 898151

SEQ ID NO: 898156 - protein, 179 aa, Homo sapiens
LGQFVRDCASFRGCGSHSECQRKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 898157 - protein, 75 aa, Homo sapiens
HTLHFTKTFTSTLQMTPSELTQAVEEEDKMTPEQLAIKNVGKQDPKRHLEEHVDVLMTSNIVQCLAAMLDTVVFK

SEQ ID NO: 898158 - protein, 310 aa, Homo sapiens; identical to SEQ ID NO: 898151

SEQ ID NO: 898159 - protein, 310 aa, Homo sapiens; identical to SEQ ID NO: 898151

SEQ ID NO: 898160 - protein, 270 aa, Homo sapiens
MLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 898161 - protein, 270 aa, Homo sapiens; identical to SEQ ID NO: 898160

SEQ ID NO: 898162 - protein, 227 aa, Homo sapiens
MAEVEVEVKEGEDDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 898163 - protein, 212 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLTDIILPVESTDAVGIL

SEQ ID NO: 898164 - protein, 1924 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 898165 - protein, 1924 aa, Homo sapiens; identical to SEQ ID NO: 898164

SEQ ID NO: 898166 - protein, 1924 aa, Homo sapiens; identical to SEQ ID NO: 898164

SEQ ID NO: 898167 - protein, 1924 aa, Homo sapiens; identical to SEQ ID NO: 898164

SEQ ID NO: 898168 - protein, 1177 aa, Homo sapiens
MKKRPVFQEDQVPRNEGSATQKHYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 898169 - protein, 1870 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFR

SEQ ID NO: 898170 - protein, 1903 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRFYN

SEQ ID NO: 898171 - protein, 1717 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITGKEPTTRLHFWENETLC

SEQ ID NO: 898172 - protein, 480 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKVAGKQDPGRQITVTIT

SEQ ID NO: 898173 - protein, 1924 aa, Homo sapiens; identical to SEQ ID NO: 898164

SEQ ID NO: 898174 - protein, 1924 aa, Homo sapiens; identical to SEQ ID NO: 898164

SEQ ID NO: 898175 - protein, 1924 aa, Homo sapiens; identical to SEQ ID NO: 898164

SEQ ID NO: 898176 - protein, 1924 aa, Homo sapiens; identical to SEQ ID NO: 898164

SEQ ID NO: 898177 - protein, 964 aa, Homo sapiens
KGKRNGRKGTTRKGNKKGNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQNLYSYENQPQPSDECTLLSNKYLDGNANKSTSDGSPVMAVMPGTTDTIQVLKGRMDSEQSPSIGYSSRTLGPNPGLILQALTLSNASDGFNLERLEMLGDSFLKHAITTYLFCTYPDAHEGRLSYMRSKKVSNCNLYRLGKKKGLPSRMVVSIFDPPVNWLPPGYVVNQDKSNTDKWEKDEMTKDCMLANGKLDEDYEEEDEEEESLMWRAPKEEADYEDDFLEYDQEHIRFIDNMLMGSGAFVKKISLSPFSTTDSAYEWKMPKKSSLGSMPFSSDFEDFDYSSWDAMCYLDPSKAVEEDDFVVGFWNPSEENCGVDTGKQSISYDLHTEQCIADKSIADCVEALLGCYLTSCGERAAQLFLCSLGLKVLPVIKRTDREKALCPTRENFNSQQKNLSVSCAAASVASSRSSVLKDSEYGCLKIPPRCMFDHPDADKTLNHLISGFENFEKKINYRFKNKAYLLQAFTHASYHYNTITDCYQRLEFLGDAILDYLITKHLYEDPRQHSPGVLTDLRSALVNNTIFASLAVKYDYHKYFKAVSPELFHVIDDFVQFQLEKNEMQGMDSELRRSEEDEEKEEDIEVPKAMGDIFESLAGAIYMDSGMSLETVWQVYYPMMRPLIEKFSANVPRSPVRELLEMEPETAKFSPAERTYDGKVRVTVEVVGKGKFKGVGRSYRIAKSAAARRALRSLKANQPQVPNS

SEQ ID NO: 898178 - protein, 1224 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDDDVFPPYVLRPDDGGPRVTINTAIGHINRYCARLPSDPFTHLAPKCRTRELPDGTFYSTLYLPINSPLRASIVGPPMSCVRLAERVVALICCEKLHKIGELDDHLMPVGKETVKYEEELDLHDEEETSVPGRPGSTKRRQCYPKAIPECLRDSYPRPDQPCYLYVIGMVLTTPLPDELNFRRRKLYPPEDTTRCFGILTAKPIPQIPHFPVYTRSGEVTISIELKKSGFMLSLQMLELITRLHQYIFSHILRLEKPALEFKPTDADSAYCVLPLNVVNDSSTLDIDFKFMEDIEKSEARIGIPSTKYTKETPFVFKLEDYQDAVIIPRYRNFDQPHRFYVADVYTDLTPLSKFPSPEYETFAEYYKTKYNLDLTNLNQPLLDVDHTSSRLNLLTPRHLNQKGKALPLSSAEKRKAKWESLQNKQILVPELCAIHPIPASLWRKAVCLPSILYRLHCLLTAEELRAQTASDAGVGVRSLPADFRYPNLDFGWKKSIDSKSFISISNSSSAENDNYCKHSTIVPENAAHQGANRTSSLENHDQMSVNCRTLLSESPGKLHVEVSADLTAINGLSYNQNLANGSYDLANRDFCQGNQLNYYKQEIPVQPTTSYSIQIL

SEQ ID NO: 898179 - protein, 620 aa, Homo sapiens
MKSPALQPLSMAGLQLMTPASSPMGPFFGLPWQQEAIHDNIYTPRKYQVELLEAALDHNTIVCLNTGSGKTFIASTTLLKSCLYLDLGETSARNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVVDCGPFTDRSGLYERLLMELEEALNFINDCNISVHSKERDSTLISKQILSDCRAVLVVLGPWCADKVAGMMVRELQKYIKHEQEELHRKFLLFTDTFLRKIHALCEEHFSPASLDLKFVTPKVIKLLEILRKYKPYERHSFESVEWYNNRNQDNYVSWSDSEDDDEDEEIEEKEKPETNFPSPFTNILCGIIFVERRYTAVVLNRLIKEAGKQDPELAYISSNFITGHGIGKNQPRNKQMEAEFRKQEEVLRKFRAHETNLLIATSIVEEGVDIPKCNLVVRFDLPTEYRSYVQSKGRARAPISNYIMLADTDKIKSFEEDLKTYKAIEKILRNKCSKSVDTGETDIDPVMDDRSVLVRVLRRT

SEQ ID NO: 898180 - protein, 473 aa, Homo sapiens
AAAAGNWRKETLASQGPRLGQRRGAWGGAGFGPAWGRMVNLESMHTDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 898181 - protein, 187 aa, Homo sapiens
WVLVVSRGSPVEGFGDVGLAMGKLYGNDFSQTTISRFEALNLSFKNMCKLKPLLEKWLNDAESSPSDPSVSTPSSYPSLSEVFGRKRKKRTSIETNIRLTLEKRFQDVSPSGSLGPLSVPPVHSTMPGTVTSSCSPGNNSRPSSPGSGLHASSPTASQNNSKAAVNSASSFNSSGSWYRWNHSTYLH

SEQ ID NO: 898182 - protein, 834 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 898183 - protein, 834 aa, Homo sapiens; identical to SEQ ID NO: 898182

SEQ ID NO: 898184 - protein, 834 aa, Homo sapiens; identical to SEQ ID NO: 898182

SEQ ID NO: 898185 - protein, 834 aa, Homo sapiens; identical to SEQ ID NO: 898182

SEQ ID NO: 898186 - protein, 533 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 898187 - protein, 834 aa, Homo sapiens; identical to SEQ ID NO: 898182

SEQ ID NO: 898188 - protein, 438 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGD

SEQ ID NO: 898189 - protein, 438 aa, Homo sapiens; identical to SEQ ID NO: 898188

SEQ ID NO: 898190 - protein, 546 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGELMIHCLLFSFKTMETCEDGNDLVFFYQVCEGVAKASHASHTAAQAGLPDKLVARGKEVMRSKCATTSTSELPFIPSPTGPGSRSTGFLTLISPSLPHSPYSSHLLACS

SEQ ID NO: 898191 - protein, 517 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 898192 - protein, 407 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVAKAVNNATAQSLVLIDEFGKGTNTVDGLALLAAVLRHWLARGPTCPHIFVATNFLSLVQLQLLPQGPLVQYLDWPRVSGQEGGLRRCCEGQPCLPHSCPGWAS

SEQ ID NO: 898193 - protein, 834 aa, Homo sapiens; identical to SEQ ID NO: 898182

SEQ ID NO: 898194 - protein, 850 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 898195 - protein, 834 aa, Homo sapiens; identical to SEQ ID NO: 898182

SEQ ID NO: 898196 - protein, 834 aa, Homo sapiens; identical to SEQ ID NO: 898182

SEQ ID NO: 898197 - protein, 616 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMVKTLNLCKVSDEENESAAEEERYSTAALPNMGSLLCSFTLSFTSTETKEREVRVEGLEVGLERWGRRGGPRDAKSTALNPCTQFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 898198 - protein, 457 aa, Homo sapiens
MAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGLRRCCEGQPCLPHSCPGWAS

SEQ ID NO: 898199 - protein, 606 aa, Homo sapiens
AGPVFLAGFKKYMLTHLAELSMIKTLTGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 898200 - protein, 457 aa, Homo sapiens; identical to SEQ ID NO: 898198

SEQ ID NO: 898201 - protein, 499 aa, Homo sapiens
AAGELGGFSCHVSYAAAATRLVGSMSATAAARKRGKPASGAGAGAGAGKRRRKADSAGDRGKSKGGGKMNEEISSDSESESLAPRKPEEEEEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLFGHQDAVAALDALSRECCVTAGGRDGTVRVWKIPEESQLVFYGHQGSIDCIHLINEEHMVSGADDGSVALWGLSKKRPLALQREAHGLRGEPGLEQPFWISSVAALLNTDLVATGSHSSCVRLWQCGEGFRQLDLLCDIPLVGFINSLKFSSSGDFLVAGVGQEHRLGRWWRIKEARNSVCIIPLRRVPVPPAAGS

SEQ ID NO: 898202 - protein, 499 aa, Homo sapiens; identical to SEQ ID NO: 898201

SEQ ID NO: 898203 - protein, 429 aa, Homo sapiens
AAGELGGFSCHVSYAAAATRLVGSMSATAAARKRGKPASGAGAGAGAGKRRRKADSAGDRGKSKGGGKMNEEISSDSESESLAPRKPEEEEEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLFGHQDAVAALDALSRECCVTAGGRDGTVRVWKIPEESQLVFYGHQGSIDCIHLINEEHMVSGADDGSVALWGLSKKRPLALQREAHGLRGEPGLEQPFWISSVAALLNTDLVATGSPVPGSRSAMW

SEQ ID NO: 898204 - protein, 104 aa, Homo sapiens
MRSTWCPARTMALWPCGVSPRSDHLPCSVKLTGCGESQAWSSPSGYRRWQPSSTQTLWPQAPTAPVCGFGSVGKASGSLTFSVTSPWWVLSTASSSPALGTSGS

SEQ ID NO: 898205 - protein, 438 aa, Homo sapiens
RYRHVAWLFARLLCLFYIPETQAETPCGRLEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLFGHQDAVAALDALSRECCVTAGGRDGTVRVWKIPEESQLVFYGHQGSIDCIHLINEEHMVSGADDGSVALWGLSKKRPLALQREAHGLRGEPGLEQPFWISSVAALLNTDLVATGSHSSCVRLWQCGEGFRQLDLLCDIPLVGFINSLKFSSSGDFLVAGVGQEHRLGRWWRIKEARNSVCIIPLRRVPVPPAAGS

SEQ ID NO: 898206 - protein, 499 aa, Homo sapiens; identical to SEQ ID NO: 898201

SEQ ID NO: 898207 - protein, 535 aa, Homo sapiens
AAGELGGFSCHVSYAAAATRLVGSMSATAAARKRGKPASGAGAGAGAGKRRRKADSAGDRGKSKGGGKMNEEISSDSESESLAPRKPEEEEEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLFGHQDAVAALDALSRECCVTAGGRDGTVRVWKIPEESQLVFYGHQGSIDCIHLINEEHMVSGADDGSVALWGLSKKRPLALQREAHGLRGEPGLEQPFWISSVAALLNTDLVATGSHSSCVRLWQCGEGFRQLDLLCDIPLVGFINSLKFSSSGDFLVAGVGQEHRYVWPSRVQVRWCRLDSSVEMGWRLGRVSAASCTPCRLGRWWRIKEARNSVCIIPLRRVPVPPAAGS

SEQ ID NO: 898208 - protein, 325 aa, Homo sapiens
AAGELGGFSCHVSYAAAATRLVGSMSATAAARKRGKPASGAGAGAGAGKRRRKADSAGDRGKSKGGGKMNEEISSDSESESLAPRKPEEEEEEELEETAQEKKLRLAKLYLEQLRQQEEEKAEARAFEEDQVAGRLKEDVLEQRGRLQKLVAKEIQAPASADIRVLRGHQLSITCLVVTPDDSAIFSAAKDCSIIKWSVESGRKLHVIPRAKKGAEGKPPGHSSHVLCMAISSDGKYLASGDRSKLILIWEAQSCQHLYTFTGHRDAVSGLAFRRGTHQLYSTSHDRSVKVWNVAENSYVETLSDTGRCGDSDRCYRALTALEPG

SEQ ID NO: 898209 - protein, 618 aa, Homo sapiens
MLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 898210 - protein, 486 aa, Homo sapiens [sequence omitted]

SEQ ID NO: 898211 - protein, 618 aa, Homo sapiens; identical to SEQ ID NO: 898209

SEQ ID NO: 898212 - protein, 618 aa, Homo sapiens; identical to SEQ ID NO: 898209

SEQ ID NO: 898213 - protein, 618 aa, Homo sapiens; identical to SEQ ID NO: 898209

SEQ ID NO: 898214 - protein, 1172 aa, Homo sapiens
IDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKTSNPIDVAARPGTVPHTLLQKDPRLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 898215 - protein, 1138 aa, Homo sapiens
IDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 898216 - protein, 618 aa, Homo sapiens; identical to SEQ ID NO: 898209

SEQ ID NO: 898217 - protein, 618 aa, Homo sapiens; identical to SEQ ID NO: 898209

SEQ ID NO: 898218 - protein, 496 aa, Homo sapiens
IDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSDPSCF

SEQ ID NO: 898219 - protein, 2080 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898220 - protein, 284 aa, Homo sapiens
TYVVKLHLFCLPAHICLSPLIACLFGFVLQNGEKVLPKDDIECPLGWKWEDEEWSTDLNRAVDEQGWEYSITIPPERKPKHWVPAEKMYYTHRRRRWVRLRRRDLSQMEALKRVSQQVVGGSEACGHRWPVGTDADLHAHRHMHVCTQHAQTPGTHWRCSQITPSIPKDHTQHTHRSHPAYPKITPSIHTDHTQHTDHTGNTHRSHSAHTQITPSTHTDHTQHTDYTQHTHRSHPAHRSHPQITPSACTDHTQHTQRSHPAHTHRSHPTHPQFTLSTHRSHPTH

SEQ ID NO: 898221 - protein, 1640 aa, Homo sapiens
SRLVRSEFRIRPSLLPCSRDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898222 - protein, 1156 aa, Homo sapiens
TYVVKLHLFCLPAHICLSPLIACLFGFVLQNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898223 - protein, 782 aa, Homo sapiens
MVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898224 - protein, 591 aa, Homo sapiens
SRTLLDMDFDTLCVSDIIMIRNVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898225 - protein, 450 aa, Homo sapiens
SRLVRSEFRIRPSLLPCSRDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898226 - protein, 1215 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRVSQQVVGGSEACGHRWPVGTDADLHAHRHMHVCTQHAQTPGTHWRCSQITPSIPKDHTQHTHRSHPAYPKITPSIHTDHTQHTDHTGNTHRSHSAHTQITPSTHTDHTQHTDYTQHTHRSHPAHRSHPQITPSACTDHTQHTQRSHPAHTHRSHPTHPQFTLSTHRSHPTH

SEQ ID NO: 898227 - protein, 486 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKNKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898228 - protein, 2087 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898229 - protein, 982 aa, Homo sapiens
MDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898230 - protein, 959 aa, Homo sapiens
MNLPDDPAACSHFQNHCPRVCSSDTNLPLGQDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898231 - protein, 2073 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 898232 - protein, 1916 aa, Homo sapiens
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKVSVLPIPCGASTRASKVSLT

SEQ ID NO: 898233 - protein, 71 aa, Homo sapiens
APSPASSQAMLVGTTECQGPSLGYFTQGRFLKAPPTPSCKLGPRVSGRSRVCDHAPNSEMVPGEMGGTAKQ

SEQ ID NO: 898234 - protein, 116 aa, Homo sapiens
ARGVEPGQYRRRCALCGGLCASGGREREAAAASVGMSRSSKVVLGLSVLLTAATVAGVHVKQQWDQQRLRDGVIRDIERQIRKKENIRLLGEQIILTEQLEAEREKMLLAKGSQKS

SEQ ID NO: 898235 - protein, 782 aa, Homo sapiens
MDSSIHLSSLISRHDDEATRTSTSEGLEEGEVEGETLLIVESEDQASVDLSHDQSGDSLNSDEGDVSWMEEQLSYFCDKCQKWIPASQLREQLSYLKGDNFFRFTCSDCSADGKEQYERLKLTWQQVVMLAMYNLSLEGSGRQGYFRWKEDICAFIEKHWTFLLGNRKKTSTWWSTVAGCLSVGSPMYFRSGAQEFGEPGWWKLVHNKPPTMKPEGEKLSASTLKIKAASKPTLDPIITVEGLRKRASRNPVESAMELKEKRSRTQEAKDIRRAQKEAAGFLDRSTSSTPVKFISRGRRPDVILEKGEVIDFSSLSSSDRTPLTSPSPSPSLDFSAPGTPASHSATPSLLSEADLIPDVMPPQALFHDDDEMEGDGVIDPGMEYVPPPAGSVASGPVVGGRKKVRGPEQIKQEVESEEEKPDRMDIDSEDTDSNTSLQTRAREKRKPQLEKDTKPKEPRYTPVSIYEEKLLLKRLEACPGAVAMTPEARRLKRKLIVRQAKRDRGLPLFDLDQVVNAALLLVDGIYGAKEGGISRLPAGQATYRTTCQDFRILDRYQTSLPSRKGFRHQTTKFLYRLVGSEDMAVDQSIVSPYTSRILKPYIRRDYETKPPKLQLLSQIRSHLHRSDPHWTPEPDAPLDYCYVRPNHIPTINSMCQEFFWPGIDLSECLQYPDFSVVVLYKKVIIAFGFMVPDVKYNEAYISFLFVHPEWRRAGIATFMIYHLIQTCMGKDVTLHVSASNPAMLLYQKFGFKTEEYVLDFYDKYYPLESTECKHAFFLRLRR

SEQ ID NO: 898236 - protein, 782 aa, Homo sapiens; identical to SEQ ID NO: 898235

SEQ ID NO: 898237 - protein, 782 aa, Homo sapiens; identical to SEQ ID NO: 898235

SEQ ID NO: 898238 - protein, 782 aa, Homo sapiens; identical to SEQ ID NO: 898235

SEQ ID NO: 898239 - protein, 654 aa, Homo sapiens
MLAMYNLSLEGSGRQGYFRWKEDICAFIEKHWTFLLGNRKKTSTWWSTVAGCLSVGSPMYFRSGAQEFGEPGWWKLVHNKPPTMKPEGEKLSASTLKIKAASKPTLDPIITVEGLRKRASRNPVESAMELKEKRSRTQEAKDIRRAQKEAAGFLDRSTSSTPVKFISRGRRPDVILEKGEVIDFSSLSSSDRTPLTSPSPSPSLDFSAPGTPASHSATPSLLSEADLIPDVMPPQALFHDDDEMEGDGVIDPGMEYVPPPAGSVASGPVVGGRKKVRGPEQIKQEVESEEEKPDRMDIDSEDTDSNTSLQTRAREKRKPQLEKDTKPKEPRYTPVSIYEEKLLLKRLEACPGAVAMTPEARRLKRKLIVRQAKRDRGLPLFDLDQVVNAALLLVDGIYGAKEGGISRLPAGQATYRTTCQDFRILDRYQTSLPSRKGFRHQTTKFLYRLVGSEDMAVDQSIVSPYTSRILKPYIRRDYETKPPKLQLLSQIRSHLHRSDPHWTPEPDAPLDYCYVRPNHIPTINSMCQEFFWPGIDLSECLQYPDFSVVVLYKKVIIAFGFMVPDVKYNEAYISFLFVHPEWRRAGIATFMIYHLIQTCMGKDVTLHVSASNPAMLLYQKFGFKTEEYVLDFYDKYYPLESTECKHAFFLRLRR

SEQ ID NO: 898240 - protein, 782 aa, Homo sapiens; identical to SEQ ID NO: 898235

SEQ ID NO: 898241 - protein, 782 aa, Homo sapiens; identical to SEQ ID NO: 898235

SEQ ID NO: 898242 - protein, 307 aa, Homo sapiens
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 898243 - protein, 307 aa, Homo sapiens; identical to SEQ ID NO: 898242

SEQ ID NO: 898244 - protein, 307 aa, Homo sapiens; identical to SEQ ID NO: 898242

SEQ ID NO: 898245 - protein, 307 aa, Homo sapiens; identical to SEQ ID NO: 898242

SEQ ID NO: 898246 - protein, 307 aa, Homo sapiens; identical to SEQ ID NO: 898242

SEQ ID NO: 898247 - protein, 307 aa, Homo sapiens; identical to SEQ ID NO: 898242

SEQ ID NO: 898248 - protein, 307 aa, Homo sapiens; identical to SEQ ID NO: 898242

SEQ ID NO: 898249 - protein, 68 aa, Homo sapiens
HVIYSVKFFISYAIPDVSKRTKSKIQREKYLTQKLLHENHLKDMTKNMGVIAERMIEAVDNNLRPKSE

SEQ ID NO: 898250 - protein, 68 aa, Homo sapiens; identical to SEQ ID NO: 898249

SEQ ID NO: 898251 - protein, 163 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKVIYRSGDRFH

SEQ ID NO: 898252 - protein, 136 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWG

SEQ ID NO: 898253 - protein, 527 aa, Homo sapiens [sequence omitted]

SEQ ID NO: 898254 - protein, 496 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDTENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 898255 - protein, 275 aa, Homo sapiens
MMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDTENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 898256 - protein, 291 aa, Homo sapiens
MTFSVPCFQAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDTENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 898257 - protein, 373 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDTENAKRAYAEAVHLDKYALC

SEQ ID NO: 898258 - protein, 145 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWALLHDFLAVC

SEQ ID NO: 898259 - protein, 519 aa, Homo sapiens [sequence omitted]

SEQ ID NO: 898260 - protein, 136 aa, Homo sapiens; identical to SEQ ID NO: 898252

SEQ ID NO: 898261 - protein, 519 aa, Homo sapiens [sequence omitted]

SEQ ID NO: 898262 - protein, 347 aa, Homo sapiens
MLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDTENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 898263 - protein, 122 aa, Homo sapiens
MEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 898264 - protein, 113 aa, Homo sapiens
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLGK

SEQ ID NO: 898265 - protein, 721 aa, Homo sapiens
MILYLRTTIYSLWTLYAIEVYCPIVVTILFTVGPALQQLWFVSRWELKQVIPPKELVSSSRRDSLCQLSREKRTRLADPAPRIVPSPGPPSRPPSACNFPSGSGTVLEWPVADTEPPASCICLSWKSLPTLPVTLGSPKKFTDLPEALGNDPGTPGQRGLKLFGKAAGLLGKMVMAPSPSLVQVYTSPAAVAMAGGLGTWHPYSATICSFIEQQFVQQKGQRFGLGSLAHSIPLGQADPSLVRYIIDLPSWTQFRQDTGTTRTVRRHLFPQHSAPGRGVVWEWLSDDGSWTAYEAGVCDDLEQQVARGNQLVDLAPLGYNYTVNYTTHTQTNKTSSFCCSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWDAAPPSLGSQPLYRSSLSHLGPQHLPPGSSTSGAVSASLPSGPSSSPGSVPATVPMQMPKPSRVQQALAGATPKPEPEPEQVIKNYTEELKVPPDEDCIICMEKLSAASGYSDVTDSKAIGPLAVGCLTKCSHAFHLLCLLAMYCNGNKGPEHPNPGKPFTARGFPRQCYLPDNAQGRKPPGGFQNPETLADIPASPQLLTDGHYMTLPVSPDQLPCDDPMAGSGGAPVLRVGHDHGCHQQPFCNAPLPGPGPYRTEPAKAIKPIDRKSVHQICSGPVVLSLSTG

SEQ ID NO: 898266 - protein, 639 aa, Homo sapiens
MILYLRTTIYSLWTLYAIEVYCPIVVTILFTVGPALQQLWFVSRWELKQVIPPKELVSSSRRDSLCQLSREKRTRLADPAPRIVPSPGPPSRPPSACNFPSGSGTVLEWPVADTEPPASCICLSWKSLPTLPVTLGSPKKFTDLPEALGNDPGTPGQRGLKLFGKAAGLLGKMVMAPSPSLVQVYTSPAAVAMAGGLGTWHPYSATICSFIEQQFVQQKGQRFGLGSLAHSIPLGQADPSLVRYIIDLPSWTQFRQDTGTTRTVRRHLFPQHSAPGRGVVWEWLSDDGSWTAYEAGVCDDLEQQVARGNQLVDLAPLGYNYTVNYTTHTQTNKTSSFCCSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWDAAPPSLGSQPLYRSSLSHLGPQHLPPGSSTSGAVSASLPSGPSSSPGSVPATVPMQMPKPSRVQQALAGATPKPEPEPEQVIKNYTEELKVPPDEDCIICMEKLSAASGYSDVTDSKAIGPLAVGCLTKCSHAFHLLCLLAMYCNGNKGPEHPNPGKPFTARGFPRQCYLPDNAQGRKVSATMSPGGGRGPDQAAGGQAPHW

SEQ ID NO: 898267 - protein, 133 aa, Homo sapiens
MWGRRRKLRRLNDVTISTCHVSAKVGTRLVFDHDGKIIQKTPYPHPRGTTVSVKQLFSTLPVRHKEFQRNIKKKRACFPFAFCRDCQLLEGSPAMLPVRPAKLTPRSTPPHPCSLEDNVITVFSSCQEWSRFF

SEQ ID NO: 898268 - protein, 88 aa, Homo sapiens
VPHTGLPVWAPLAFPPGSLDLFLAFLALWPPLQPVLLRTLLMYFSLLGATPKPEPEPEQVIKNYTEELKVPPDEVCVLGPWLPLFLFG

SEQ ID NO: 898269 - protein, 90 aa, Homo sapiens
PQPTSPPASRLASKSHGSVKRLRKMSVKGATPKPEPEPEQVIKNYTEELLRAPGARGLVWGEKDFPSLDGRGFWVSFFYLNFVCNKCSTA

SEQ ID NO: 898270 - protein, 133 aa, Homo sapiens; identical to SEQ ID NO: 898267

SEQ ID NO: 898271 - protein, 142 aa, Homo sapiens
MILYLRTTIYSLWTLYAIEVYCPIVVTILFTVGPALQQLWFVSRWELKQVIPPKELVSSSRRDSLCQLSREKRTRLADPAPRIVPSPGPPSRPPSACNFPSGSGTVLEWPVADTEPPASCICLSWKSLPTLPVTLGSPKKSR

SEQ ID NO: 898272 - protein, 153 aa, Homo sapiens
LTFGFPLKTGTTRTVRRHLFPQHSAPGRGVVWEWLSDDGSWTAYEAGVCDDLEQQVARGNQLVDLAPLGYNYTVNYTTHTQTNKTSSFCCSVRRQAGPPYPVTTIIAPPGHTGVACSCHQCLSGSRTGPVSGRYRHSMTNLPAYPVPQHPPHR

SEQ ID NO: 898273 - protein, 1534 aa, Homo sapiens
PPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNNKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDKQEQKGSVGATFKLGDSLSNPNERAIVKEKMVSNTKSVDTKASSSKFSRILTPKEYLQRQKHKEALSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKGNTEKSNMLEFKLCPDILLKNTNSVEERKDVKPHPRKEQAPLQVSGIKSTKEDWLKFVATKKRTQKDSQERDNVNSRLSKRSFSADGFEMLQNPVKDSKEMFQTYKQMYLEKRSRSLGSSPVK

SEQ ID NO: 898274 - protein, 1534 aa, Homo sapiens; identical to SEQ ID NO: 898273

SEQ ID NO: 898275 - protein, 1457 aa, Homo sapiens
PPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNNKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDKQEQKGSVGATFKLGDSLSNPNERAIVKEKMVSNTKSVDTKASSSKFSRILTPKEYLQRQKHKEALSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKGNTEKSNMLEFKLCPDILLKNTNSVEERKDVKPHPRKEQAPLQGPV

SEQ ID NO: 898276 - protein, 1474 aa, Homo sapiens
PPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNNKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDKQEQKGSVGATFKLGDSLSNPNERAIVKEKMVSNTKSVDTKASSSKFSRILTPKEYLQRQKHKEALSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKANHTPTYHPRQQNTPTPSPSHLHAPGQHLVNPNNISNLHLYPPSPPTTPHRPPPVPPAPPSSP

SEQ ID NO: 898277 - protein, 156 aa, Homo sapiens
PPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNNKQPFNSPIRSSVDGVQIGGGANH

SEQ ID NO: 898278 - protein, 1534 aa, Homo sapiens; identical to SEQ ID NO: 898273

SEQ ID NO: 898279 - protein, 1622 aa, Homo sapiens
PPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNNKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDKQEQKGSVGATFKLGDSLSNPNERAIVKEKMVSNTKSVDTKASSSKFSRILTPKEYLQRQKHKEALSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKGNTEKSNMLEFKLCPDILLKNTNSVEERKDVKPHPRKEQAPLQVSGIKSTKEDWLKFVATKKRTQKDSQERDNVNSRLSKRSFSADGFEMLQNPVKDSKEMFQTYKQMYLEKRSRSLDGVLLCLPYRLECRGAVLAHCSLCLPGSGYSPASASRVAAINRKVGRAWWEAPVVPATREAEAGEWREPGRQSLQCAEIAPLHSSLGDRARLLL

SEQ ID NO: 898280 - protein, 862 aa, Homo sapiens
PPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNNKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPCTLTSSNLSVLS

SEQ ID NO: 898281 - protein, 203 aa, Homo sapiens
NSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHF

SEQ ID NO: 898282 - protein, 190 aa, Homo sapiens
MAKATTIKEALARWEEKTGQRPSEAKEIKLYAQIPPIEKMDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 898283 - protein, 111 aa, Homo sapiens
SSGINAEGPLRPGLATRAVTVATAGMAKATTIKEALARWEEKTGQRPSEAKEIKLYAQIPPIEKMDASLSMLANCEKLSLSTNCIEKIANLNGLRGSRGHIRRTVDLLQFY

SEQ ID NO: 898284 - protein, 190 aa, Homo sapiens; identical to SEQ ID NO: 898282

SEQ ID NO: 898285 - protein, 399 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRWANKGGLIAYRSRKRLETFLSLLVQNLAPAETHT

SEQ ID NO: 898286 - protein, 399 aa, Homo sapiens; identical to SEQ ID NO: 898285

SEQ ID NO: 898287 - protein, 399 aa, Homo sapiens; identical to SEQ ID NO: 898285

SEQ ID NO: 898288 - protein, 399 aa, Homo sapiens; identical to SEQ ID NO: 898285

SEQ ID NO: 898289 - protein, 202 aa, Homo sapiens
MGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRWANKGGLIAYRSRKRLETFLSLLVQNLAPAETHT

SEQ ID NO: 898290 - protein, 291 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGDPHAFTTAHHLYQETAVKHTLETPALGENAASEIHTPRPVPAC

SEQ ID NO: 898291 - protein, 399 aa, Homo sapiens; identical to SEQ ID NO: 898285

SEQ ID NO: 898292 - protein, 399 aa, Homo sapiens; identical to SEQ ID NO: 898285

SEQ ID NO: 898293 - protein, 399 aa, Homo sapiens; identical to SEQ ID NO: 898285

SEQ ID NO: 898294 - protein, 399 aa, Homo sapiens; identical to SEQ ID NO: 898285

SEQ ID NO: 898295 - protein, 385 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRYLSLPVLETVSVSVSCAVCF

SEQ ID NO: 898296 - protein, 276 aa, Homo sapiens
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHACR

SEQ ID NO: 898297 - protein, 443 aa, Homo sapiens
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 898298 - protein, 443 aa, Homo sapiens; identical to SEQ ID NO: 898297

SEQ ID NO: 898299 - protein, 443 aa, Homo sapiens; identical to SEQ ID NO: 898297

SEQ ID NO: 898300 - protein, 342 aa, Homo sapiens
MCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 898301 - protein, 158 aa, Homo sapiens
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHCKCLPILIRYT

SEQ ID NO: 898302 - protein, 443 aa, Homo sapiens; identical to SEQ ID NO: 898297

SEQ ID NO: 898303 - protein, 443 aa, Homo sapiens; identical to SEQ ID NO: 898297

SEQ ID NO: 898304 - protein, 452 aa, Homo sapiens
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKELIKMFCYLI

SEQ ID NO: 898305 - protein, 256 aa, Homo sapiens
MDRLGSFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKKKKKQKKTFNVWLCTLQSACLICSSLLRRWHRI

SEQ ID NO: 898306 - protein, 63 aa, Homo sapiens
MARTRLDHSMSVETCPPTSSLSVVMVHFRCKLDWIKDSLKCQASEPKLSHHIPCDLHVHIQMA

SEQ ID NO: 898307 - protein, 423 aa, Homo sapiens [sequence omitted]

SEQ ID NO: 898308 - protein, 338 aa, Homo sapiens
MWSLISLLRASFCECPWTNTWKWRTSHQILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVESGSLKSTLTGNKVFNCISYSPLCKRLASGSTDRHIRLWDPRTKDGSLVSLSLTSHTGWVTSVKWSPTHEQQLISGSLDNIVKLWDTRSCKAPLYDLAAHEDKVLSVDWTDTGLLLSGGADNKLYSYRYSPTTSHVGA

SEQ ID NO: 898309 - protein, 374 aa, Homo sapiens
MAQLQTRFYTDNKKYAVDDVPFSIPAASEIADLSNIINKLLKDKNEFHKHVEFDFLIKGQFLRMPLDKHMEMENISSEEVVEIEYVEKYTAPQPEQCMFHDDWISSIKGAEEWILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVESGSLKSTLTGNKVFNCISYSPLCKRLASGSTDRHIRLWDPRTKDGSLVSLSLTSHTGWVTSVKWSPTHEQQLISGSLDNIVKLWDTRR

SEQ ID NO: 898310 - protein, 206 aa, Homo sapiens
MAQLQTRFYTDNKKYAVDDVPFSIPAASEIADLSNIINKLLKDKNEFHKHVEFDFLIKGQFLRMPLDKHMEMENISSEEVVEIEYVEKYTAPQPEQCMFHDDWISSIKGAEEWILTGSYDKTSRIWSLEGKSIMTIVGHTDVVKDVAWVKKDSLSCLLLSASMDQTILLWEWNVERNKVKALHCCRGHAGSVDSIAVDGSGTKVSS

SEQ ID NO: 898311 - protein, 527 aa, Homo sapiens
MAQLQTRFYTDNKKYAVDDVPFSIPAASEIADLSNIINKLLKDKNEFHKHVEFDFLIKGQFLRMPLDKHMEMENISSEEVVEIEYVEKYTAPQPEQCMFHDDWISSIKGAEEWILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVESGSLKSTLTGNKVFNCISYSPLCKRLASGSTDRHIRLWDPRTKDGSLVSLSLTSHTGWVTSVKWSPTHEQQLISGSLDNIVKLWDTRSCKAPLYDLAAHEDKVLSVDWTDTGLLLSGGARPKIGFLPDIHLPLSRWGTDTGTLTLTISASFPQAQSGYRHLYVPCTSMPKAPFRMYSLSLTPPTATIHFPLSDSPHPARHTPPADHPPTHHQGYVHHNQRPDTTAISTPYAPQLTPRPSCS

SEQ ID NO: 898312 - protein, 421 aa, Homo sapiens
MRKLILSVSSSRYAVDDVPFSIPAASEIADLSNIINKLLKDKNEFHKHVEFDFLIKGQFLRMPLDKHMEMENISSEEVVEIEYVEKYTAPQPEQCMFHDDWISSIKGAEEWILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVESGSLKSTLTGNKVFNCISYSPLCKRLASGSTDRHIRLWDPRTKDGSLVSLSLTSHTGWVTSVKWSPTHEQQLISGSLDNIVKLWDTRSCKAPLYDLAAHEDKVLSVDWTDTGLLLSGGADNKLYSYRYSPTTSHVGA

SEQ ID NO: 898313 - protein, 212 aa, Homo sapiens
MLKIWSTVPTDEEDEMEESTNRPRKKQKTEQLGLTRTPIVTLSGHMEAVSSVLWSDAEEICSASWDHTIRVWDVESGSLKSTLTGNKVFNCISYSPLCKRLASGSTDRHIRLWDPRTKDGSLVSLSLTSHTGWVTSVKWSPTHEQQLISGSLDNIVKLWDTRSCKAPLYDLAAHEDKVLSVDWTDTGLLLSGGADNKLYSYRYSPTTSHVGA

SEQ ID NO: 898314 - protein, 144 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDIMFNLDKVHIILDEMVLNGCIVETNRARILAPLLILDKMSES

SEQ ID NO: 898315 - protein, 144 aa, Homo sapiens; identical to SEQ ID NO: 898314

SEQ ID NO: 898316 - protein, 144 aa, Homo sapiens; identical to SEQ ID NO: 898314

SEQ ID NO: 898317 - protein, 103 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELVN

SEQ ID NO: 898318 - protein, 77 aa, Homo sapiens
GPEKGGKMPILVPLFGLFISRGTNKSKLSVERPQTGLSHREVLGPKPRRPGKAASGGAPADAILKAKMAAPEEARTA

SEQ ID NO: 898319 - protein, 104 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELSNG

SEQ ID NO: 898320 - protein, 295 aa, Homo sapiens
PRSAPIAAPRDHPPPAPGSLQARSGSRYLEADSGATEPGQPRQRRGARQGRPADPETPSQRAPRAGSLAGGGGGGHGGRARAPLAQRSMPVWCCRCSLAGHFRNYSDTETEGEIFNSLVQYFGDNLGRKVKAMPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRR

SEQ ID NO: 898321 - protein, 505 aa, Homo sapiens
MPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 898322 - protein, 505 aa, Homo sapiens; identical to SEQ ID NO: 898321

SEQ ID NO: 898323 - protein, 637 aa, Homo sapiens
PRSAPIAAPRDHPPPAPGSLQARSGSRYLEADSGATEPGQPRQRRGARQGRPADPETPSQRAPRAGSLAGGGGGGHGGRARAPLAQRSMPVWCCRCSLAGHFRNYSDTETEGEIFNSLVQYFGDNLGRKVKAMPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 898324 - protein, 637 aa, Homo sapiens; identical to SEQ ID NO: 898323

SEQ ID NO: 898325 - protein, 258 aa, Homo sapiens
SSVGTNRQCLEWTKNHEFHISLKPELGNGLTLTLLEKMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 898326 - protein, 74 aa, Homo sapiens
MHPAKTGLTDSLAFGGGLPGAWGKLATFNSWYLFNSVAFQNADATRRTCPQLTTYGCHGSGQLSKQVPVVSSAV

SEQ ID NO: 898327 - protein, 74 aa, Homo sapiens; identical to SEQ ID NO: 898326

SEQ ID NO: 898328 - protein, 74 aa, Homo sapiens; identical to SEQ ID NO: 898326

SEQ ID NO: 898329 - protein, 74 aa, Homo sapiens; identical to SEQ ID NO: 898326

SEQ ID NO: 898330 - protein, 74 aa, Homo sapiens; identical to SEQ ID NO: 898326

SEQ ID NO: 898331 - protein, 74 aa, Homo sapiens; identical to SEQ ID NO: 898326

SEQ ID NO: 898332 - protein, 161 aa, Homo sapiens
MARVPPTGQFRFRAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGVRGLSILALILVFVISSLALSFYILFRQRGKKQ

SEQ ID NO: 898333 - protein, 133 aa, Homo sapiens
MLSLANVLSLANVLSLANVLSQPPVQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGNGL

SEQ ID NO: 898334 - protein, 773 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898335 - protein, 754 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898336 - protein, 798 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPTKCFYHLRAFPGNELEMELPRDTHRAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898337 - protein, 773 aa, Homo sapiens; identical to SEQ ID NO: 898334

SEQ ID NO: 898338 - protein, 786 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLLLPMEITSGGIDPHHHMRVPAARLHLPIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898339 - protein, 748 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898340 - protein, 758 aa, Homo sapiens
MIRDLSKMYPQTRHPAPHQPAQPFKFTISESCDRIKEEFQFLQAQYHSLKLECEKLASEKTEMQRHYVMAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898341 - protein, 752 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898342 - protein, 366 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMVNLVWGLNVILLLALFELPSYI

SEQ ID NO: 898343 - protein, 295 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPV

SEQ ID NO: 898344 - protein, 106 aa, Homo sapiens
RPPPSSPGLTAARRHGAGPPDGPVSIPGEEGVGAARGSLGACLWPGRGDGTRTLGVRGAGACGREYAGPQDHLETSLCLGCWARGGLREESFNLSLLACAMTLTPR

SEQ ID NO: 898345 - protein, 206 aa, Homo sapiens
MARVPPTGQFRFRAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSSKTTCCS

SEQ ID NO: 898346 - protein, 100 aa, Homo sapiens
MIRDLSKMYPQTRHPAPHQPAQPFKFTISESCDRIKEEFQFLQAQYHSLKLECEKLASEKTEMQRHYVMVRKPCHRFKVPISLEYQKQEYVEIAGGCKID

SEQ ID NO: 898347 - protein, 805 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898348 - protein, 1104 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMVNLVWGLNVILLLALFELPSYIDGNNFPFLSKKYISHLQKSILTYITNHKCKNELLTHQDNLPAPYSSVAVYVNCNFVWCVFFPHQLFPCNITFKKRIKRQIQFSNNLWNSQLKERKFLTGLQIRGDKCDGLDCWCCFFKFYFLLAFWPSFNGTCSLLSLYDNSSLDVFSNVTCSQEASCDMNNLPGAHSYPSLYQSHQQVATVEDILVCEPHLTQTNFLEMSCSPLNSASVYVFPNIRSAVSRNSFVSLLTFLLKKIKAQAEEPLPFLFLLSFSLPFYCLTSLLKPCSNCWYMSFHLLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898349 - protein, 786 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGEKKNKSDTPGSLKQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898350 - protein, 711 aa, Homo sapiens
MQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898351 - protein, 805 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQRLFFSKLKAVATLNGAVLPIACAHFVSLCHILAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 898352 - protein, 773 aa, Homo sapiens; identical to SEQ ID NO: 898334

SEQ ID NO: 898353 - protein, 208 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSSKTTCCS

SEQ ID NO: 898354 - protein, 163 aa, Homo sapiens [sequence omitted]

SEQ ID NO: 898355 - protein, 782 aa, Homo sapiens
HVLVLTGQLPGGKPRLLQVGKLDVFAMGKRGSRSQSQLLNTLTKKQKKHLRDFGEEHPFYDRVSRKEAKPQICQLSESSDSSDSESDSESEPQQVSGYHRLLATLKNVSEEEEEDEEEEEEEDSIVDDAEMNDEDGGSDVSVEEEMAAESTESPENVALSADPEGKEDGEEPPGTSQTSPEEFTDAKHESLFSLETNFLEEESGDNSSLKASQDPFLQHVNKELKEKAIQAVATNPKTTHELKWPILGQLFFSSKFQKLETFKPPKDIDLKSLHLQKPLESTWTKTNSQFLSGPQKSSSPFTPLQKELFLIMNSYRDLFYPERTALKNGEEIRHVYCLHVINHILKANAQVLGNNSRRRSQKFGVGDDDDFRDQGLTRPKVLIVVPFREAALRVVQLFISLLEGDSKKKIIVSNKKRFQGEYGSDPEERPPNLKRPEDYEAVFVGNIDDHFRIGVAILQRSIRLYAPFYSSDILIASPLGLRTIIGGEGEKKRDFDFLSSIELLIIDQADIYLMQNWEHVLHLMNHMNLLPLDSHGVDFSRVRMWSLNNWSKYYRQTLLFGALQDAQINSVFNKYCVNMQGQVAVRNVPMTGSISHVLVQLPHVFQRMEAENLASVIDARFNFFVNKILPQYRDAVMSHTLIYIPSYFDFVRLRNYFKKEELNFTHICEYTQKSGVSRARHFFLQGEKQFLLFTERFHFYKRYTIKGIRNLIFYELPTYPHFYSEICNMLRATNRGEEATWTCTVLYSKYDAQRLAAVVGVERAAQMLQSNKNVHLFITGEK

SEQ ID NO: 898356 - protein, 782 aa, Homo sapiens; identical to SEQ ID NO: 898355

SEQ ID NO: 898357 - protein, 72 aa, Homo sapiens
HLMNHMNLLPLDSHGVDFSRVRMWSLNNWSKYYRQTLLFGALQDAQINSVFNKYCVNMQGQVGSRLVSSVSS

SEQ ID NO: 898358 - protein, 230 aa, Homo sapiens
RRMQYNRRFVNVVPTFGKKKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 898359 - protein, 186 aa, Homo sapiens
ESSSVPAGGAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 898360 - protein, 158 aa, Homo sapiens
MADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 898361 - protein, 226 aa, Homo sapiens
ESSSVPAGGAVVITDRQTGKSRGYGFVTMADRAAAERACKDPNPIIDGRKANVNLAYLGAKPRSLQTGFAIGVQQLHPTLIQRTYGCRTLGNSPGPVCEMGLMMGRPSRRGDAPSHSTGLPPAWALLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 898362 - protein, 117 aa, Homo sapiens
MVVPAWGGQWPSALPAGAVECRRVRLFPLPPHHLLCASLRRFLPVLGVGGGWRQFCQPWQGCYGASRAVGVWRRGHEVRGILAEGGGQRGVSLRTYLRELSVQALQGRPGTESRLRE

SEQ ID NO: 898363 - protein, 291 aa, Homo sapiens
RSAAHSARTAGAAPRVVGPGGWTGAPRCPARSPPPPMSAPRAARVRSGGAPPMLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 898364 - protein, 239 aa, Homo sapiens
MLLQPAPCAPSAGFPRPLAAPGAMHGSQKDTTFTKIFVGGLPYHTTDASLRKYFEGFGDIEEAVVITDRQTGKSRGYGFVTMADRAAAERACKDPNPIIDGRKANVNLAYLGAKPRSLQTGFAIGVQQLHPTLIQRTYGLTPHYIYPPAIVQPSVVIPAAPVPSLSSPYIEYTPASPAYAQYPPATYDQYPYAASPATAASFVGYSYPAAVPQALSAAAPAGTTFVQYQAPQLQPDRMQ

SEQ ID NO: 898365 - protein, 122 aa, Homo sapiens
ESSSVPAGGAVVITDRQTGKSRGYGFVTMADRAAAERACKDPNPIIDGRKANVNLAYLGDRPADNVSDACSRGGRASATHQDSNGVRYNGRTKCRHHRFRKTKCGTQQLLSHCSHSAEHGVT

SEQ ID NO: 898366 - protein, 291 aa, Homo sapiens; identical to SEQ ID NO: 898363

SEQ ID NO: 898367 - protein, 158 aa, Homo sapiens; identical to SEQ ID NO: 898360

SEQ ID NO: 898368 - protein, 112 aa, Homo sapiens
RRMQYNRRFVNVVPTFGKKKDTTFTKIFVGGLPYHTTDASLRKYFEGFGDIEEAVVITDRQTGKSRGYGFVTMADRAAAERACKDPNPIIDGRKANVNLAYLGAKPRSLQTG

SEQ ID NO: 898369 - protein, 291 aa, Homo sapiens; identical to SEQ ID NO: 898363

SEQ ID NO: 898370 - protein, 291 aa, Homo sapiens; identical to SEQ ID NO: 898363

SEQ ID NO: 898371 - protein, 1326 aa, Homo sapiens
MLLSPSLLLLLLLGGAAGCAEGVAAALTPERLLEWQDKGIFVIQSESLKKCIQAGKSVLTLGRTGSKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWVGLNQLDEDAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 898372 - protein, 158 aa, Homo sapiens
MKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNW

SEQ ID NO: 898373 - protein, 1393 aa, Homo sapiens
MLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWVGLNQLDEDAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWEETCGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 898374 - protein, 893 aa, Homo sapiens
MKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 898375 - protein, 1313 aa, Homo sapiens
MLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWVGLNQLDEDAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWEETCGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEAGR

SEQ ID NO: 898376 - protein, 658 aa, Homo sapiens
MLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWVGLNQLDEDAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWEETCGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNW

SEQ ID NO: 898377 - protein, 1465 aa, Homo sapiens
MLLSPSLLLLLLLGGAAGCAEGVAAALTPERLLEWQDKGIFVIQSESLKKCIQAGKSVLTLGRTGSKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWVGLNQLDEDAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 898378 - protein, 1393 aa, Homo sapiens; identical to SEQ ID NO: 898373

SEQ ID NO: 898379 - protein, 1010 aa, Homo sapiens
MTLQSSLLIGTHLSPTFFQIEASCVSQQSSLRDTGKSKIVKKDFFTFVKKQAMSSLMLNQDVKRDGRRHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 898380 - protein, 235 aa, Homo sapiens
NHNWLFFTETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 898381 - protein, 802 aa, Homo sapiens
MLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWVGLNQLDEDAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWEETCGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKAVLEHNSP

SEQ ID NO: 898382 - protein, 292 aa, Homo sapiens [sequence omitted]

SEQ ID NO: 898383 - protein, 292 aa, Homo sapiens [sequence omitted]

SEQ ID NO: 898384 - protein, 292 aa, Homo sapiens [sequence omitted]

SEQ ID NO: 898385 - protein, 119 aa, Homo sapiens
MPAQRLPLSWMPGWPSTHHPKLPAMGTPVHPTQSLWAGLQCMGRATAPTPGTCRACRQPGKLCRPVGGPSHRVPCASSPSPTTCSRASGLCIWHRASSWTTPGLALPGPWLKAGFRWPR

SEQ ID NO: 898386 - protein, 251 aa, Homo sapiens
MEPGEELEEEGSPGGREDGFTAEHLAAEAMAADMDPWLVFDARTTPATELDAWLAKYPPSQVTRYGDPGSPNSEPVGWIAVYGQGYSPNSGDVQGLQAAWEALQTSGRPITPGTLRQLAITHHVLSGKWLMHLAPGFKLDHAWAGIARAVVEGRLQVAKVSPRAKEGGRQVICVYTDDFTDRLGVLEADSAIRAAGIKCLLTYKPDVYTYLGIYRANRWHLCPTLYESRFQLGGSARGSRVLDRANNVELT

SEQ ID NO: 898387 - protein, 251 aa, Homo sapiens; identical to SEQ ID NO: 898386

SEQ ID NO: 898388 - protein, 88 aa, Homo sapiens
DAWVRTRGSTHAVDDFTDRLGVLEADSAIRAAGIKCLLTYKPDVYTYLGIYRANRWHLCPTLYESRFQLGGSARGSRVLDRANNVELT

SEQ ID NO: 898389 - protein, 471 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898390 - protein, 457 aa, Homo sapiens
TWEEAENNMADGEEPMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898391 - protein, 229 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVISM

SEQ ID NO: 898392 - protein, 135 aa, Homo sapiens
TWEEAENNMADGEEPEKKRRRIEELLAEKLVLPGGRGPLRGPPPPPTPGLGDQPQRARGAGRGTPGAQAALPHPLIPAPQPRGPGGPLPVSARCGRRGQAVLPQLLQGPSGVLDVKVLRKDPCALLFLHPKLSEQ

SEQ ID NO: 898393 - protein, 349 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATRWAVYIHI

SEQ ID NO: 898394 - protein, 444 aa, Homo sapiens
TWEEAENNMADGEEPEKKRRRIEELLAEKMAVDGGCGDTGDWEGRWNHVKKFLERSGPFTHPDFEPSTEALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898395 - protein, 457 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898396 - protein, 178 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPISYYCMWTGLYHRQKMDKWHADISSKL

SEQ ID NO: 898397 - protein, 471 aa, Homo sapiens; identical to SEQ ID NO: 898389

SEQ ID NO: 898398 - protein, 334 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVVCH

SEQ ID NO: 898399 - protein, 270 aa, Homo sapiens
MADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGERGYH

SEQ ID NO: 898400 - protein, 470 aa, Homo sapiens
YVSSDLTAEEEEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898401 - protein, 87 aa, Homo sapiens
TWEEAENNMADGEEPEKKRRRIEELLAEKMAVDGGCGDTGDWEGRWNHVKKFLERSGPFTHPDFEPSTESEKRLFLNNCSNSFMFQN

SEQ ID NO: 898402 - protein, 471 aa, Homo sapiens; identical to SEQ ID NO: 898389

SEQ ID NO: 898403 - protein, 363 aa, Homo sapiens
MDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898404 - protein, 443 aa, Homo sapiens
TWEEAENNMADGEEPMAVDGGCGDTGDWEGRWNHVKKFLERSGPFTHPDFEPSTESLQFLLDTCKVLVIGAGGLGCELLKNLTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898405 - protein, 286 aa, Homo sapiens
MLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 898406 - protein, 439 aa, Homo sapiens
TWEEAENNMADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLMGRRWIFVPSVKKIYETMYFLTCFK

SEQ ID NO: 898407 - protein, 101 aa, Homo sapiens
LTNGPMGPGARFSQRGDAGSWAACYHEAEGDGAGHQPAPGLGFSWAWAEGWRPVGDVFKTAQQPHLTVSRWGLSPTPRLPREHSLHSYTLATLPEGEAVLE

SEQ ID NO: 898408 - protein, 96 aa, Homo sapiens
LHNESLKFLCITSIPRMYLPPFSLFLKRSIKGKLPQPVKFIIFGLWRMESKSYFQKWPPHPGSLAELRSGSLTCLFSPCFQLPYDDCVFGGQRLTL

SEQ ID NO: 898409 - protein, 388 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSLTPGLILLKVQYMAPFYLQLFMVLDRELGLGACMSD

SEQ ID NO: 898410 - protein, 503 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 898411 - protein, 503 aa, Homo sapiens; identical to SEQ ID NO: 898410

SEQ ID NO: 898412 - protein, 503 aa, Homo sapiens; identical to SEQ ID NO: 898410

SEQ ID NO: 898413 - protein, 503 aa, Homo sapiens; identical to SEQ ID NO: 898410

SEQ ID NO: 898414 - protein, 206 aa, Homo sapiens
MTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 898415 - protein, 383 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGMSASLPCPTPSEGR

SEQ ID NO: 898416 - protein, 200 aa, Homo sapiens
AAPNNYYIRGRSTWELAVKSLCWCFKQFEGLYVDCEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 898417 - protein, 383 aa, Homo sapiens; identical to SEQ ID NO: 898415

SEQ ID NO: 898418 - protein, 187 aa, Homo sapiens
MDKVKFRTPLLTPNNLFLFLRQSPTLSPRLECSDAVSAHRNLRSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 898419 - protein, 387 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNDHTCLHLLYPWLPDSPGDP

SEQ ID NO: 898420 - protein, 503 aa, Homo sapiens; identical to SEQ ID NO: 898410

SEQ ID NO: 898421 - protein, 503 aa, Homo sapiens; identical to SEQ ID NO: 898410

SEQ ID NO: 898422 - protein, 503 aa, Homo sapiens; identical to SEQ ID NO: 898410

SEQ ID NO: 898423 - protein, 503 aa, Homo sapiens; identical to SEQ ID NO: 898410

SEQ ID NO: 898424 - protein, 271 aa, Homo sapiens
ALRNPPQPAPPWAPRGALTTPGVFPSLPHRFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 898425 - protein, 473 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLVRVHGVHRGRAAL

SEQ ID NO: 898426 - protein, 424 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQVGASCPRRTESGSSCLCCEQKFQMQP

SEQ ID NO: 898427 - protein, 383 aa, Homo sapiens; identical to SEQ ID NO: 898415

SEQ ID NO: 898428 - protein, 447 aa, Homo sapiens
KRSKNGKDRQVGKPQRGTAHQVGVLGISAADDPNSNRSWETPGKEGSLAEGQDYRVQAAGKYRGEGAWSEGLSSHSALIKKFPVRDPSGSSQGVSPMNPSSGFRLLFPPSRGRSQFSFSGLTGLEIPQSLTPPQRNPQPAFIGRRGGAAEPTAVRAAVPPASAPARKQRAARGPAHPQQRPQLVRAMFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQVDAAANLVVVIV

SEQ ID NO: 898429 - protein, 1338 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGNPPRRSKSAPPRDLGNLDKGQAASPREPLEPLNFPDPEYKEEEEDQDIQGEISHPDGKVEKVYKNGCRVILFPNGTRKEVSADGKTITVTFFNGDVKQVMPDQRVIYYYAAAQTTHTTYPEGLEVLHFSSGQIEKHYPDGRKEITFPDQTVKNLFPDGQEESIFPDGTIVRVQRDGNKLIEFNNGQRELHTAQFKRREYPDGTVKTVYANGHQETKYRSGRIRVKDKEGNVLMDTEL

SEQ ID NO: 898430 - protein, 1136 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGTAQPPHTPSSLLADHLPPLSSFRPFSRNIQLRYTF

SEQ ID NO: 898431 - protein, 1321 aa, Homo sapiens
MLRRLRCRFVLLSCPGFTERLEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGNPPRRSKSAPPRDLGNLDKGQAASPREPLEPLNFPDPEYKEEEEDQDIQGEISHPDGKVEKVYKNGCRVILFPNGTRKEVSADGKTITVTFFNGDVKQVMPDQRVIYYYAAAQTTHTTYPEGLEVLHFSSGQIEKHYPDGRKEITFPDQTVKNLFPDGQEESIFPDGTIVRVQRDGNKLIEFNNGQRELHTAQFKRREYPDGTVKTVYANGHQETKYRSGRIRVKDKEGNVLMDTEL

SEQ ID NO: 898432 - protein, 398 aa, Homo sapiens
RPEVLWEVRTSGRGRGSDRGGDCGGPFVNAAEIEVSVRAAELPRLHGAVLEINSSSSTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGNPPRRSKSAPPRDLGNLDKGQAASPREPLEPLNFPDPEYKEEEEDQDIQGEISHPDGKVEKVYKNGCRVILFPNGTRKEVSADGKTITVTFFNGDVKQVMPDQRVIYYYAAAQTTHTTYPEGLEVLHFSSGQIEKHYPDGRKEITFPDQTVKNLFPDGQEESIFPDGTIVRVQRDGNKLIEFNNGQRELHTAQFKRREYPDGTVKTVYANGHQETKYRSGRIRVKDKEGNVLMDTEL

SEQ ID NO: 898433 - protein, 912 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGESEHYKICIRMVEI

SEQ ID NO: 898434 - protein, 143 aa, Homo sapiens
MESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGESEHYKICIRMVEI

SEQ ID NO: 898435 - protein, 1388 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGTAQPPHTPSSLLADHLPPLSSFRPFSRNIQLVTLFNMEVRFWHLLETLPSNPPRRSKSAPPRDLGNLDKGQAASPREPLEPLNFPDPEYKEEEEDQDIQGEISHPDGKVEKVYKNGCRVILFPNGTRKEVSADGKTITVTFFNGDVKQVMPDQRVIYYYAAAQTTHTTYPEGLEVLHFSSGQIEKHYPDGRKEITFPDQTVKNLFPDGQEESIFPDGTIVRVQRDGNKLIEFNNGQRELHTAQFKRREYPDGTVKTVYANGHQETKYRSGRIRVKDKEGNVLMDTEL

SEQ ID NO: 898436 - protein, 1101 aa, Homo sapiens
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQDFKTANSRFTGRFEKKGNQMVKYTQPSQKPDTNVSQREHRPPGRNKSDGKIPTGCLEESRSHREQPRGGEEGQACEHICSISKQSDFFRNPGRKIQEKLSSNAR

SEQ ID NO: 898437 - protein, 587 aa, Homo sapiens
MFSSLHSALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVELLGPLDRGDMLNEAFIGLSLAPQGEDSFPDNLPPSCPTHRHILQQRILNGSSNRQIIDRRNELEKDICSGFLMTNTCNAEDGELREDGREQEIRDGGSLKMIHFGLV

SEQ ID NO: 898438 - protein, 613 aa, Homo sapiens
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQPGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMNSWDPWTEGIC

SEQ ID NO: 898439 - protein, 584 aa, Homo sapiens
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQPGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRNSC

SEQ ID NO: 898440 - protein, 615 aa, Homo sapiens
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQPGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMVLGHMCGTCRFVT

SEQ ID NO: 898441 - protein, 554 aa, Homo sapiens
MESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVELLGPLDRGDMLNEAFIGLSLAPQGEDSFPDNLPPSCPTHRHILQQRILNGSSNRQIIDRRNELEKDICSGFLMTNTCNAEDGELREDGREQEIRDGGSLKMIHFGLV

SEQ ID NO: 898442 - protein, 587 aa, Homo sapiens; identical to SEQ ID NO: 898437

SEQ ID NO: 898443 - protein, 671 aa, Homo sapiens
MRREFCWDAYSKAAGSRASSPLPRQDRDSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQPGSGVLVSLSLSGPQLEKVVIDRSLVGKLISDTISDALLTDSFIILSFLAQNKLCFIQFTKKMESSDVNKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGCEDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLRYQRFEKAFLLAVDVGARDLFMDIHYLALDKGELALAEVARKRASDIDAESITSGVERATTIMNTNIHGQHLQQALVTTYSYKPQNISGQG

SEQ ID NO: 898444 - protein, 77 aa, Homo sapiens
SLRCSRHSHLATSSPLPCARRAGIGPGESGAVVRCSTVCGEEKGRRGENCTGSRRSSHRPAVGLFTIGSKGKRRRSI

SEQ ID NO: 898445 - protein, 367 aa, Homo sapiens
FESGAGDNTSIKDKFEAAGGVDIGSWFCAGNENTSEDKSAPKAKAKKSSESRGIYPYMVPGAGMGSWDGAMIWSETKFAHQSEASFPVEDESRKQTRTGEKTRPWSCRCKHEANMDPRDLEKLICMIEMTEDPSVHEIANNALYNSADYSYSHEVVRNVGGISVIESLLNNPYPSVRQKALNALNNISVAAENHRKVKTYLNQVCEDTVTYPLNSNVQLAGLRLIRHLTITSEYQHMVTNYISEFLRLLTVGSGETKDHVLGMLLNFSKNPSMTKDLLIANAPTSLINIFSKKETKENILNALSLFENINYHFKRRAKAFTQDKFSKNSLYFLFQRPKACAKKLRALAAECNDPEVKERVELLISKL

SEQ ID NO: 898446 - protein, 192 aa, Homo sapiens
MSAAGLKITGSKETKRRLLLISIDWVYCQEKQEERRELPRIITGPPPEAAVVAFEWLKTSTLTGLHPQLPLSLPQPECALPYLVRAFSRGDYMGRIQEVGWVTAGLVIWAGTCYYIYKFTKGRAQSVRTLARNGSTVKMETVVGVQSQTLAINEAEIKTKPQVEIGAETGARSGPGAEVETKATAILLISKL

SEQ ID NO: 898447 - protein, 146 aa, Homo sapiens [sequence omitted]

SEQ ID NO: 898448 - protein, 66 aa, Homo sapiens
APTPGPDQPGERATGKPPLVRFGPSSGRFGAKVFELICEDSRAIHKVRKYSRKRQLLEGQRIRGWW

SEQ ID NO: 898449 - protein, 312 aa, Homo sapiens
MANRTVKDAHSIHGTNPQYLVEKIIRTRIYESKYWKEECFGLTAELVVDKAMELRFVGGVYGGNIKPTPFLCLTLKMLQIQPEKDIIVEFIKNEDFKYVRMLGALYMRLTGTAIDCYKYLEPLYNDYRKIKSQNRNGEFELMHVDEFIDELLHSERVCDIILPRLQKRYVLEEAEQLEPRVSALEEDMDDVESSEEEEEEDEKLERVPSPDHRRRSYRDLDKPRRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 898450 - protein, 146 aa, Homo sapiens [sequence omitted]

SEQ ID NO: 898451 - protein, 146 aa, Homo sapiens [sequence omitted]

SEQ ID NO: 898452 - protein, 146 aa, Homo sapiens [sequence omitted]

SEQ ID NO: 898453 - protein, 146 aa, Homo sapiens [sequence omitted]

SEQ ID NO: 898454 - protein, 149 aa, Homo sapiens [sequence omitted]

SEQ ID NO: 898455 - protein, 146 aa, Homo sapiens [sequence omitted]

SEQ ID NO: 898456 - protein, 148 aa, Homo sapiens
EDPRREVEVEVKEGVSWKECHHLITAGEATETWTSPVALPHCATGGVGAGLPEGGVDLPKGEAPPLAEKGIGARVQDVTAAGPEIGGTDPVPSPQVITVVTDTGATQSLPKGLRRATRRAGEGMSNGLSLVLVHMASCGYKDICMWKD

SEQ ID NO: 898457 - protein, 312 aa, Homo sapiens; identical to SEQ ID NO: 898449

SEQ ID NO: 898458 - protein, 412 aa, Homo sapiens
MDTSPSRKYPVKKRVKIHPNTVMVKYTSHYPQPGDDGYEEINEGYGNFMEENPKKGLLSEMKKKGRAFFGTMDTLPPPTEDPMINEIGQFQSFAEKNIFQSRKMWIVLFGSALAHGCVALITRLVSDRSKVPSLELIFIRSVFQVLSVLVVCYYQEAPFGPSGYRLRLFFYGVCNVISITCAYTSFSIVPPSNGTTMWRATTTVFSAILAFLLVDEKMAYVDMATVVCSILGVCLVMIPNIVDEDNSLLNAWKEAFGYTMTVMAGLTTALSMIVYRSIKEKISMWTALFTFGWTGTIWGISTMFILQEPIIPLDGETWSYLIAICVCSTAAFLGVYYALDKFHPALVSTVQHLEIVVAMVLQLLVLHIFPSIYDVFGGVIIMISVFVLAGYKLYWRNLRRQDYQEILDSPIK

SEQ ID NO: 898459 - protein, 412 aa, Homo sapiens; identical to SEQ ID NO: 898458

SEQ ID NO: 898460 - protein, 412 aa, Homo sapiens; identical to SEQ ID NO: 898458

SEQ ID NO: 898461 - protein, 412 aa, Homo sapiens; identical to SEQ ID NO: 898458

SEQ ID NO: 898462 - protein, 412 aa, Homo sapiens; identical to SEQ ID NO: 898458

SEQ ID NO: 898463 - protein, 412 aa, Homo sapiens; identical to SEQ ID NO: 898458

SEQ ID NO: 898464 - protein, 412 aa, Homo sapiens; identical to SEQ ID NO: 898458

SEQ ID NO: 898465 - protein, 412 aa, Homo sapiens; identical to SEQ ID NO: 898458

SEQ ID NO: 898466 - protein, 412 aa, Homo sapiens; identical to SEQ ID NO: 898458

SEQ ID NO: 898467 - protein, 93 aa, Homo sapiens
KQTGQVHKHCIAMQVRHLDGSTNMRTDRSGTICSSELPGAFEAAGFHLNEHLYNMIIRRYSDESGNMDFDNFISCLVRLDAMFLRSHVNMRTD

SEQ ID NO: 898468 - protein, 282 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALL

SEQ ID NO: 898469 - protein, 282 aa, Homo sapiens; identical to SEQ ID NO: 898468

SEQ ID NO: 898470 - protein, 282 aa, Homo sapiens; identical to SEQ ID NO: 898468

SEQ ID NO: 898471 - protein, 282 aa, Homo sapiens; identical to SEQ ID NO: 898468

SEQ ID NO: 898472 - protein, 170 aa, Homo sapiens
MEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALL

SEQ ID NO: 898473 - protein, 292 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDLSLFLTPSHQSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALL

SEQ ID NO: 898474 - protein, 292 aa, Homo sapiens; identical to SEQ ID NO: 898473

SEQ ID NO: 898475 - protein, 283 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGGKDPHIGVWVPGRTPPLSPSYQL

SEQ ID NO: 898476 - protein, 125 aa, Homo sapiens
KQTGQVHKHCIAMQVRHLDGSTNMRTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALL

SEQ ID NO: 898477 - protein, 282 aa, Homo sapiens; identical to SEQ ID NO: 898468

SEQ ID NO: 898478 - protein, 282 aa, Homo sapiens; identical to SEQ ID NO: 898468

SEQ ID NO: 898479 - protein, 256 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFPFKSLCTEMALERIDE

SEQ ID NO: 898480 - protein, 249 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRSHPLRNLSPVPVPSLALVMPPNAPEGPLSVLGG

SEQ ID NO: 898481 - protein, 85 aa, Homo sapiens
MGQRLTSIDTCSINNDHLNAKKYLPQNHATIITPAGLNHHRGQPSIINRREHEARTIMRDYRDEIHYAGPQQTIAPNRDPTSDTT

SEQ ID NO: 898482 - protein, 205 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAVPPE

SEQ ID NO: 898483 - protein, 191 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAYTNSSTLISLDQWTS

SEQ ID NO: 898484 - protein, 40 aa, Homo sapiens
MRNSNESCRRTQAKERRQRTDTNKPEKHTENEQSNEHKDT

SEQ ID NO: 898485 - protein, 282 aa, Homo sapiens; identical to SEQ ID NO: 898468

SEQ ID NO: 898486 - protein, 282 aa, Homo sapiens; identical to SEQ ID NO: 898468

SEQ ID NO: 898487 - protein, 224 aa, Homo sapiens
MRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALL

SEQ ID NO: 898488 - protein, 252 aa, Homo sapiens
MFLVNSFLKGGGGGGGGGGGLGGGLGNVLGGLISGAGGGGGGGGGGGGGGGGGGGGTAMRILGGVISAISEAAAQYNPEPPDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALL

SEQ ID NO: 898489 - protein, 282 aa, Homo sapiens; identical to SEQ ID NO: 898468

SEQ ID NO: 898490 - protein, 85 aa, Homo sapiens; identical to SEQ ID NO: 898481

SEQ ID NO: 898491 - protein, 267 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAADSDESGNMDFDNFISCLVRLDAMFRAFKSLDKDGTGQIQVNIQGVAAADYVFLNWEPQTRPLTALL

SEQ ID NO: 898492 - protein, 288 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQGVAAADYVFLNWEPQTRPLTALPLGSRTL

SEQ ID NO: 898493 - protein, 247 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFPARPRRK

SEQ ID NO: 898494 - protein, 129 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANPWALGHSNKLCPRVSPFPPGPAHTHSVTSPLYLCQA

SEQ ID NO: 898495 - protein, 85 aa, Homo sapiens; identical to SEQ ID NO: 898481

SEQ ID NO: 898496 - protein, 149 aa, Homo sapiens
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRQPDLKADGFGPIEGILRCS

SEQ ID NO: 898497 - protein, 184 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 898498 - protein, 184 aa, Homo sapiens; identical to SEQ ID NO: 898497

SEQ ID NO: 898499 - protein, 184 aa, Homo sapiens; identical to SEQ ID NO: 898497

SEQ ID NO: 898500 - protein, 184 aa, Homo sapiens; identical to SEQ ID NO: 898497

SEQ ID NO: 898501 - protein, 213 aa, Homo sapiens
HASRTRGSRTRGRTGPRRSVGDSSVPWVPSSVILQRSHGRTAAPALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 898502 - protein, 119 aa, Homo sapiens [sequence omitted]

SEQ ID NO: 898503 - protein, 104 aa, Homo sapiens
RTRGSTHASGPTRRRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 898504 - protein, 246 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKGNNVIQDIYIPEASRTDGSLSRFKLFFSPFPLPISAVPFHLTVQSFWFSSSALSHVLEYSCVTLFFR

SEQ ID NO: 898505 - protein, 184 aa, Homo sapiens; identical to SEQ ID NO: 898497

SEQ ID NO: 898506 - protein, 184 aa, Homo sapiens; identical to SEQ ID NO: 898497

SEQ ID NO: 898507 - protein, 184 aa, Homo sapiens; identical to SEQ ID NO: 898497

SEQ ID NO: 898508 - protein, 287 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNGAAEDDEDDDVDTKKQKTDEDDYDSKKDNVIPKKKKAGVTYTPSIPISESKTWSPSSREAAPPPWRAPEMNGLFTTNRNHENLHTGGYKTQLQAAFFYNVFTKHIGCHAMTLTSVLVRPPFKIGDNSLGRRPAASVGPLKPGGTLTGTTLPPLLAANVFEYPAHLWTALISLFLLFLSFIFVL

SEQ ID NO: 898509 - protein, 184 aa, Homo sapiens; identical to SEQ ID NO: 898497

SEQ ID NO: 898510 - protein, 184 aa, Homo sapiens; identical to SEQ ID NO: 898497

SEQ ID NO: 898511 - protein, 184 aa, Homo sapiens; identical to SEQ ID NO: 898497

SEQ ID NO: 898512 - protein, 149 aa, Homo sapiens [sequence omitted]

SEQ ID NO: 898513 - protein, 166 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRSYHNGNSDPRGFGHIGIAVPDVYSACKRFEELGVKFVKKPDDGKMKGLAFIQDPDGYWIEILNPNKMATLM

SEQ ID NO: 898514 - protein, 184 aa, Homo sapiens; identical to SEQ ID NO: 898497

SEQ ID NO: 898515 - protein, 184 aa, Homo sapiens; identical to SEQ ID NO: 898497

SEQ ID NO: 898516 - protein, 151 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRERPCQPCLYC

SEQ ID NO: 898517 - protein, 106 aa, Homo sapiens
MAREFLAEFMSTYVMMEWLTGMLQLCLFAIVDQENNPALPGTHALVIGILVVIIRVYHGMNTGYAINPSRDLPPPHLHLHCWLGQTGLQVASSTWSSLAPPSHGSP

SEQ ID NO: 898518 - protein, 92 aa, Homo sapiens
LQLCLFAIVDQENNPALPGTHALVIGILVVIIRVYHGMNTGYAINPSRDLPPPHLHLHCWLGQTGLQVLPLPRPIPLRFSVGPLCVEVWGVM

SEQ ID NO: 898519 - protein, 69 aa, Homo sapiens
AAAYYYYYCSEFQASNDVRGHGVRLKTNKDSLYKVLVVCVLVEMKPVLYRQGVTQTLFYNFLHTLNVQV

SEQ ID NO: 898520 - protein, 142 aa, Homo sapiens
MVQASGHRRSTRGSKMVSWSVIAKIQEIWCEEDERKMAREFLAEFMSTYVMMEWLTGMLQLCLFAIVDQENNPALPGTHALVIGILVVIIRVYHGMNTGYAINPSRDLPPPHLHLHCWLGQTGLQVASSTWSSLAPPSHGSP

SEQ ID NO: 898521 - protein, 326 aa, Homo sapiens
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEESGLHLSPTAAEAKEKARAMRVNKRAPQMDWNRKREIFSNF

SEQ ID NO: 898522 - protein, 337 aa, Homo sapiens
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898523 - protein, 378 aa, Homo sapiens
MARSGSARHLPGLRSPSTEPPQRLVQDVSGPLRSCASCTREGPQGYGFNLHSVRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898524 - protein, 242 aa, Homo sapiens
GHPGRTPATCCHCAAVMARSGSATPPARAPGAPPRSPPQRLVQDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898525 - protein, 202 aa, Homo sapiens
MPEDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898526 - protein, 337 aa, Homo sapiens; identical to SEQ ID NO: 898522

SEQ ID NO: 898527 - protein, 232 aa, Homo sapiens
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARSTGTAVAS

SEQ ID NO: 898528 - protein, 136 aa, Homo sapiens
MAAPEPLRPRLCRLVRGEQGYGFHLHGEKGRRGQFIRRVEPGSPAEAAALRAGDRLVEVNGVNVEGETHHQVGASARPRPAAPSPSASPWGEQGSHGGPRGLPRGGRGRCREAAARRLRSPGAGSSVLHGGGGGHP

SEQ ID NO: 898529 - protein, 337 aa, Homo sapiens; identical to SEQ ID NO: 898522

SEQ ID NO: 898530 - protein, 215 aa, Homo sapiens
GRTPATCCHCAAVMARSGSARHLPGLRSPSTEPPQRLVQDVSGPLRSCASCTREGPQGYGFNLHSVRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKLTERNLCFCFFSKKISSSTHVST

SEQ ID NO: 898531 - protein, 297 aa, Homo sapiens
RTPGPAQSGATAHVLPGMWATDPLLIAHSPQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898532 - protein, 406 aa, Homo sapiens
GRAWDGSGGSFRAPGGPLCPVHTKLLPQPLLAGPTGVGRLIFLECESKQSRHRSQPHGGLWRENKTAGLGAPAPRSGGEPGAGGRTGRALRDNRPRRPTATVHPTWCFLPPCLCATLASSQRNSPSNPGRRLGPSGRLLGLKTGFAQVPTAKALSQAAWVPGVFATETWACPWGARYRVWAVAAPPGSGLWRREAGARDRPCPLGLQDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898533 - protein, 161 aa, Homo sapiens
SRKSLTRRRHPRTLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 898534 - protein, 161 aa, Homo sapiens
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKLTERNLCFCFFSKKISSSTHVST

SEQ ID NO: 898535 - protein, 168 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFLGGSWRVMQEVNPPNPSTRLGLPEAIS

SEQ ID NO: 898536 - protein, 168 aa, Homo sapiens; identical to SEQ ID NO: 898535

SEQ ID NO: 898537 - protein, 168 aa, Homo sapiens; identical to SEQ ID NO: 898535

SEQ ID NO: 898538 - protein, 214 aa, Homo sapiens
TTRPTEQESAAQHTAGSEAWVSGLRRFPPSANGPLEGFKGSRPSTGMSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFLGGSWRVMQEVNPPNPSTRLGLPEAIS

SEQ ID NO: 898539 - protein, 168 aa, Homo sapiens; identical to SEQ ID NO: 898535

SEQ ID NO: 898540 - protein, 168 aa, Homo sapiens; identical to SEQ ID NO: 898535

SEQ ID NO: 898541 - protein, 168 aa, Homo sapiens; identical to SEQ ID NO: 898535

SEQ ID NO: 898542 - protein, 140 aa, Homo sapiens
MELYDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFLGGSWRVMQEVNPPNPSTRLGLPEAIS

SEQ ID NO: 898543 - protein, 120 aa, Homo sapiens
MSLFDLFRGFFGFPGPRSFSPGGGIRFHDNFGFDDLVRDFNSIFSDMGAWTLPSHPPELPGPESETPGERLREGQTLRDSMLKYPDSHQPRIFLGGSWRVMQEVNPPNPSTRLGLPEAIS

SEQ ID NO: 898544 - protein, 124 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPGVWLSLRGNLWFLVGWWVK

SEQ ID NO: 898545 - protein, 99 aa, Homo sapiens
HIAEDAIEISYKVIKAEVIVETYPSSWAWTLPSHPPELPGPESETPGERLREGQTLRDSMLKYPDSHQPRIFLGGSWRVMQEVNPPNPSTRLGLPEAIS

SEQ ID NO: 898546 - protein, 168 aa, Homo sapiens; identical to SEQ ID NO: 898535

SEQ ID NO: 898547 - protein, 176 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPANTCHLSAELPGPESETPGERLREGQTLRDSMLKYPDSHQPRIFLGGSWRVMQEVNPPNPSTRLGLPEAIS

SEQ ID NO: 898548 - protein, 168 aa, Homo sapiens; identical to SEQ ID NO: 898535

SEQ ID NO: 898549 - protein, 172 aa, Homo sapiens
KEQAVPVWEYGWGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFLGGSWRVMQEVNPPNPSTRLGLPEAIS

SEQ ID NO: 898550 - protein, 168 aa, Homo sapiens; identical to SEQ ID NO: 898535

SEQ ID NO: 898551 - protein, 168 aa, Homo sapiens; identical to SEQ ID NO: 898535

SEQ ID NO: 898552 - protein, 168 aa, Homo sapiens; identical to SEQ ID NO: 898535

SEQ ID NO: 898553 - protein, 168 aa, Homo sapiens; identical to SEQ ID NO: 898535

SEQ ID NO: 898554 - protein, 145 aa, Homo sapiens
VARSGWRLRHEGPLEGFKGSRPSTGMSLFDLFRGFFGFPGPRSFSPGGGIRFHDNFGFDDLVRDFNSIFSDMGAWTLPSHPPELPGPESETPGERLREGQTLRDSMLKYPDSHQPRIFLGGSWRVMQEVNPPNPSTRLGLPEAIS

SEQ ID NO: 898555 - protein, 176 aa, Homo sapiens; identical to SEQ ID NO: 898547

SEQ ID NO: 898556 - protein, 126 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLNFQVLSQRHLVRDYGRDRHFGTQCLSIQIVTSPGSFWGGLGE

SEQ ID NO: 898557 - protein, 957 aa, Homo sapiens
MLFTLPGLKLLIASFEQALFIMNFQTQKSRESRITNPHEPITQLQKLSIHGHLVHPCLLPCFPSFCRGSFLLRQSVALLPRLECSGATSAHCNLRLPGSSDSPASASQVAGITDARHHTWLIFVFLLEMGFHHVGQAGLELLTSSDPPALASQNAGITGVNHGAWPLYRLFIEVESEGLRKPRGKMRVWRMFVPKALSLLPDSMKYTMRHPPLGFVASVDDVSHLEPVQSWSSAGSCASEEGPKRVPLLSSSLEVPGCYYCPREVMMNDGCVQWQFAPLRQGLPLGPDRALPAGRNPCARQDSNSVACLLLPSLQEWSPSGLESHIFHDAPLSSFDSTPTSRESEFRVLGLMHLLLKLRPSPVFTFLLFFFVAQGYEGLIRCWAWSLLAFLTLLLTATAIIIRVTTYSIPYCLPGIKLSALHILSHLILIMTLGKRYHLNPIDSWFARLGGMKDPGDNARENSDPGAPGWMFFMPVNHSFITCLELGTPLKVRFWLEVVDHTYNPSTLGDQGRRTAGGQEFKTSVGNSKTLSLQKILKLAGCGGMCLKFQLLRRLRWEDHLTQEFEVTVSYDGTTALQPRQQRETLSLKYIEVFHTNTSLPSVPTSATCYNEYYNTQYVINVVSGMFDNMITTITCVPSQAQCPRLGEVGQGTQPENARPQEAIWFSRHCLLKELPMPDRRPKMIEDTMSAFKWLGTFMIVVQTNEAFTSFFYVIIQQIFAPTCAEHCDEASVTQNNTAKTPPDEPPPTTHQYSRGWFNGVFLEYEVGAGIRGGKGTSVYLISYVLFIISKSAEGELYLEPIESKSDKMKMLMKIWRNETLMGFAGNLSQCCVVNVGVPFEFIMLNPNPQSNGIKRWGLWGWVWWLHDCNPSTLGCWQGADHLKPGVSDQPGQHGETPSVLKIQKLARCDGVHLYFQPLGRLRQENSLNPVGGDFSEPRSCHCTPAWVTERDSISKK

SEQ ID NO: 898558 - protein, 970 aa, Homo sapiens
MLFTLPGLKLLIASFEQTLFIMNFQTQKSRESRITNPHEPITQLQKLSIHGHLVHPCLLPCFPSFCRGSFLLRQSVALLPRLECSGATSAHCNLRLPGSSDSPASASQVAGITDARHHTWLIFVFLLEMGFHHVGQAGLELLTSSDPARLGLPKCWDYRCEPRCLATVQVIYKKLESEGLRKPEGQMRVLEDFVPKALSLLPEQHEVTMRHPPLGFVASVDDVSHLEPVQSWSSAGSCASEEGPKRVPLLSSSLEVPGCYYCPREVMMNDGCVQWQFAPLRQGLPLGPDRALPAGRNPCARQDSNSVACLLLPSLQEWSPSGLESHIFHDAPLSSIDSTPTSRESEFRVLGLMHLLLKLRPSPVFTFLLFFFVAQGYEGLIRCWAWSLLAFLTLLLTATAIIIRVTTYSIPYCLPGIKLSALHILSHLILIMTLGKRYHLNPIDSWFARLGGMKDPGDNARENSDPGAPGWMFFMPVNHSFITCLELGTPLKVRFWLEVVDHTYNPSTLGDQGRRTAGGQEFKTSVGNSKTLSLQKILKLAGCGGMCLKFQLLRRLRWEDHLTQEFEVTVSYDGTTALQPRQQRETLSLKYIEVFHTNTSLPSVPTSATCYNEYYNTQYVINVVSGMFDNMITTITCVPSQAQCPRLGEVGQGTQPENARPQEAIWFSRHCLLKELPMPDRRPKMIEDTMSAFKWLGTFMIVVQTNEAFTSFFYVIIQQIFAPTCAEHCDEASVTQNNTAKTPPDEPPPTTHQYSRGWFNGVFLEYEVGAGIRGGKGTSVYLISYVLFIISKSAEGELYLEPIESKSDKMKMLMKIWRNETLMGFAGNLSQCCVVNVGVPFEFIMLNPNPQSNGIKRWGLWGWVWWLMTVTQHFGMLAGGRSLEARSLRQPGQHGETPSVLKIQKLARCDGVHLYFQPLGRLRQENSLNPVGGDFSEAEIVPLHSSLGDRARLHLKKIIKMWGLWEVVRS

SEQ ID NO: 898559 - protein, 451 aa, Homo sapiens
MEFKTSVGNSKTLSLQKILKLAGCGGMCLKFQLLRRLRWEDHLTQEFEVTVSYDGTTALQPRQQRETLSLKYIEVFHTNTSLPSVPTSATCYNEYYNTQYVINVVSGMFDNMITTITCVPSQAQCPRLGEVGQGTQPENARPQEAIWFSRHCLLKELPMPDRRPKMIEDTMSAFKWLGTFMIVVQTNEAFTSFFYVIIQQIFAPTCAEHCDEASVTQNNTAKTPPDEPPPTTHQYSRGWFNGVFLEYEVGAGIRGGKGTSVYLISYVLFIISKSAEGELYLEPIESKSDKMKMLMKIWRNETLMGFAGNLSQCCVVNVGVPFEFIMLNPNPQSNGIKRWGLWGWVWWLMTVTQHFGMLAGGRSLEARSLRSAWPHGETPSVLKIQKLARCDGVHLYFQPLGRLRQENSLNPVGGDFSEAEIVPLHSSLGDRARLHLKKIIKMWGLWEVVRS

SEQ ID NO: 898560 - protein, 763 aa, Homo sapiens
MRHPPLGFVASVDDVSHLEPVQSWSSAGSCASEEGPKRVPLLSSSLEVPGCYYCPREVMMNDGCVQWQFAPLRQGLPLGPDRALPAGRNPCARQDSNSVACLLLPSLQEWSPSGLESHIFHDAPLSSFDSTPTSRESEFRVLGLMHLCLKLRPSPVFTFLLFFFVAQGYEGLIRCWAWSLLAFLTLLLTATAIIIRVTTYSIPYCLPGIEAKCFTYIKSFNPHNDPMKEIPSQPNCSWFARLGGMKDPGDNARENSDPGAPGWMFFMPVNHSFITCLELGTPLKVRFWLEVVDHTYNPSTLGDQGRRTAGGQEFKTSVGNSKTLSLQKILKLAGCGGMCLKFQLLRRLRWEDHLTQEFEVTVSYDGTTALQPRQQRETLSLKYIEVFHTNTSLPSVPTSATCYNEYYNTQYVINVVSGMFDNMITTITCVPSQAQCPRLGEVGQGTQPKDARPQEAIWFSRHCLLKELPMPDRRPKMIEDTMSAFKWLGTFMIVVQTNEAFTSFFYVIIQQIFAPTCAEHCDRPPVTQNNTAKTPPDEPPPTTHQYSRGWFNGVFLEYEVGAGIRGGKGTSVYLISYVLFIISKSAEGELYLEPIESKSDKMKMLMKIWRNETLMGFAGNLSQCCVVNVGVPFEFIMLNPNPQSNGIKRWGLWGWVWWLMTVTQHFGMLAGGRSLEARSLRSAWPTWRNPICTKNTKIEPGVMAYICNFSHSGELRQENSLNPVGGDFSEAEIVPLHSSLGDRARLHLKKIIKMWGLWEVVRS

SEQ ID NO: 898561 - protein, 540 aa, Homo sapiens
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRTSDRPPDPLEPPSLPAERPGPPTPAAAHSIPYNSCREKEPSYPMPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 898562 - protein, 540 aa, Homo sapiens; identical to SEQ ID NO: 898561

SEQ ID NO: 898563 - protein, 540 aa, Homo sapiens; identical to SEQ ID NO: 898561

SEQ ID NO: 898564 - protein, 137 aa, Homo sapiens
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRERPALALLDPQPAPWPPLSFSLSLYFLPFSVILFLVTVK

SEQ ID NO: 898565 - protein, 540 aa, Homo sapiens; identical to SEQ ID NO: 898561

SEQ ID NO: 898566 - protein, 949 aa, Homo sapiens
MNFQTQKSRESRITNPHEPITQLQKLSIHGHLVHPCLLPCFPSFCRGSFLLRQSVALLPRLECSGATSAHCNLRLPGSSDSPASASQVAGITDARHHTWLIFVFLLEMGFHHVGQAGLELLTSSDPPALASQNAGITGVNHGAWPLYRLFIEVESEGLKKAKGQMRVWRILCPKALSLLPEQHEVTMRHPPLGFVASVDDVSHLEPVQSWSSAGSCASEEGPKRVPLLSSSLEVPGCYYCPREVMMNDGCVQWQFAPLRQGLPLGPDRALPAGRNPCARQDSNSVACLLLPSLQEWSPSGLESHIFHDAPLSSFDSTPTSRESEFRVLGLMHLLLKLRPSPVFTFLLFFFVAQGYEGLIRCWAWSLLAFLTLLLTATAIIIRVTTYSIPYCLPGIKLSALHILSHLILIMTLGKRYHLNPIDSWFARLGGMKDPGDNARENSDPGAPGWMFFMPVNHSFITCLELGTPLKVRFWLEVVDHTYNPSTLGDQGRRTAGGQEFKTSVGNSKTLSLQKILKLAGCGGMCLKFQLLRRLRWEDHLTQEFEVTVSYDGTTALQPRQQRETLSLKYIEVFHTNTSLPSVPTSATCYNEYYNTQYVINVVSGMFDNMITTITCVPSQAQCPRLGEVGQGTQPENARPQEAIWFSRHCLLKELPMPDRRPKMIEDTMSAFKWLGTFMIVVQTNEAFTSFFYVIIQQIFAPTCAEHCDEASVTQNNTAKTPPDEPPPTTHQYSRGWFNGVFLEYEVGAGIRGGKGTSVYLISYVLFIISKSAEGELYLEPIESKSDKMKADENMEEMKLLMGFAGNLSQCCVVNVGVPFEFIMLNPNPQSNGIKRWGLWGWVWWLYDCNPSTLGCWQGADHLKPGVSDQPGQHGETPSVLKIQKLARCDGVHLYFQPLGRLRQENSLNPVGGDFSEAEIVPLHSSLGDRARLHLKKIIKMWGLWEVVRS

SEQ ID NO: 898567 - protein, 540 aa, Homo sapiens; identical to SEQ ID NO: 898561

SEQ ID NO: 898568 - protein, 540 aa, Homo sapiens; identical to SEQ ID NO: 898561

SEQ ID NO: 898569 - protein, 540 aa, Homo sapiens; identical to SEQ ID NO: 898561

SEQ ID NO: 898570 - protein, 200 aa, Homo sapiens
MVHAFLIHTLRAPNTEDTGLCRVLYSCVFGAEKSPDDPRPHGAERDRLLRKEQILAVARQVESMCRLQQQASGRPPMDLQPQSSDEQVPLHEAPRGAFRLAAENPFQEPRTVVWLGVLSLGFALVLDAHENLLLAEGTLRLLTRLLLDHLRLLAPSTSLLLRADRIEGILTRFLPHGQLLFLNDQFVQGLEKEFSAAWPR

SEQ ID NO: 898571 - protein, 528 aa, Homo sapiens
PRGRGEGGESWPPPVFRVRGFVGVALTCSSATADPPSALSSRRSVPPGQLCEAAAGEGTMGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSVRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 898572 - protein, 355 aa, Homo sapiens
AEGARRRRGIMAAPSVPRPGVCGSCLDLQLRHRGPAFCPQQQTLCPARAALRGSGWRGNHGDCARPVTTSELTTKPRTCSLAIADGTFLLPGPYSCPYLYLKGTTTEFSAAPSKDKTQKVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWEPKWNCSVYLCEAEGGVHLLTPQPASYPDVSSCRGSLRKTGCCYSCEEDSCQVRINTTILWHQGCETEVNITFCEGSLP

SEQ ID NO: 898573 - protein, 374 aa, Homo sapiens
PRGRGEGGESWPPPVFRVRGFVGVALTCSSATADPPSALSSRRSVPPGQLCEAAAGEGTMGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVSI

SEQ ID NO: 898574 - protein, 438 aa, Homo sapiens
MKRKEENIGTITDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSVRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 898575 - protein, 494 aa, Homo sapiens
PRGRGEGGESWPPPVFRVRGFVGVALTCSSATADPPSALSSRRSVPPGQLCEAAAGEGTMGTVHARSLEPLPSSGPDFGGLGEEAEFVEVEPEAKQEILENKDVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSVRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 898576 - protein, 340 aa, Homo sapiens
PRGRGEGGESWPPPVFRVRGFVGVALTCSSATADPPSALSSRRSVPPGQLCEAAAGEGTMGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWEPKWNCSVYLCEAEGGVHLLTPQPASYPDVSSCRGSLRKTGCCYSCEEDSCQVRINTTILWHQGCETEVNITFCEGSLPR

SEQ ID NO: 898577 - protein, 528 aa, Homo sapiens; identical to SEQ ID NO: 898571

SEQ ID NO: 898578 - protein, 75 aa, Homo sapiens
PGGARPGPDPYSLKVSVGRAPKLIFVSWLSASAGRTGPGLSSGLATSLGWNLITASPWEYRQATGYVMASSLELG

SEQ ID NO: 898579 - protein, 516 aa, Homo sapiens
MSPWFRGRADMGVRTCSSATADPPSALSSRRSVPPGQLCEAAAGEGTMGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERNFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSVRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 898580 - protein, 607 aa, Homo sapiens
PRGRGEGGESWPPPVFRVRGFVGVALTCSSATADPPSALSSRRSVPPGQLCEAAAGEGTMGTVHARSLEPLPSSGPDFGGLGEEAEFVEVEPEAKQEILENKDVVVQHVHFDGLGRTKDDIIICEIGDVFKAKNLIEVMRKSHEAREKLLRLGIFRQVDVLIDTCQGDDALPNGLDVTFEVTELRRLTGSYNTMVGNNEGSMVLGLKLPNLLGRAEKVTFQFSYGTKETSYGLSFFKPRPGNFERKKEAQQIIEYTGLIEKFKIGGLFVKRTMTESAATSAVTTCCRFPLEDEPYGRSVKSVDLNVCKFYITVSAFKALIPLSPSFSVNLYKVTGQFPWSSLRETDRGMSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSVRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 898581 - protein, 259 aa, Homo sapiens
MSAEYSFPIWKTSHTVKWEGVWRELGCLSRTASFAVRKESGHSLKSSLSHAMVIDSRNSSILPRRGALLKVNQELAGYTGGDVSFIKEDFELQLNKQLIFDSVFSASFWGGMLVPIGDKPSSIADRFYLGGPTSVRGFSMHSIGPQSEGDYLGGEAYWAGGLHLYTPLPFRPGQGGFGELFRTHFFLNAGNLCNLNYGEGPKAHIRKLAECIRWSYGAGIVLRLGNIARLELNYCVPMGVQTGDRICDGVQFGAGIRFL

SEQ ID NO: 898582 - protein, 208 aa, Homo sapiens
PRGRGEGGESWPPPVFRVRGFVGVALTCSSATADPPSALSSRRSVPPGQLCEAAAGEGTMGTVHARSLEPLPSSGPDFGGLGEEAEFVEVEPEAKQEILENKDVVVQHVHFDGLGRTKDDIIICEIGELFRTHFFLNAGNLCNLNYGEGPKAHIRKLAECIRWSYGAGIVLRLGNIARLELNYCVPMGVQTGDRICDGVQFGAGIRFL

SEQ ID NO: 898583 - protein, 340 aa, Homo sapiens
RGSRACASVRVAGEEGSLTTRKFEYHSSMECDLMETDILESLEDLGYKGPLLEDGALSQAVSAGASSPEFTKLCAWLVSELRVLCKLEENVQATNSPSEAEEFQLEVSGLLGEMNCPYLSLTSGDVTKRLLIQKNCLLLLTYLISELEAARMLCVNAPPKKAQEGGGSEVFQELKGICIALGMSKPPANITMFQFFSGIEKKLKETLAKVPPNHVGKPLLKKPMGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVIRVPLIFSKCIYFCS

SEQ ID NO: 898584 - protein, 340 aa, Homo sapiens; identical to SEQ ID NO: 898583

SEQ ID NO: 898585 - protein, 546 aa, Homo sapiens
RGSRACASVRVAGEEGSLTTRKFEYHSSMECDLMETDILESLEDLGYKGPLLEDGALSQAVSAGASSPEFTKLCAWLVSELRVLCKLEENVQATNSPSEAEEFQLEVSGLLGEMNCPYLSLTSGDVTKRLLIQKNCLLLLTYLISELEAARMLCVNAPPKKAQEGGGSEVFQELKGICIALGMSKPPANITMFQFFSGIEKKLKETLAKVPPNHVGKPLLKKPMGPAHWEKIEAINQAIANEYEVRRKLLIKRLDVTVQSFGWSDRAKSQTEKLAKVYQPKRSVLSPKTTISVAHLLAARQDLSKILRTSSGSIREKTACAINKVLMGRVPDRGGRPNEIEPPPPEMPPWQKRQDGPQQQTGGRGGGRGGYEHSSYGGRGGHEQGGGRGGRGGYDHGGRGGGRGNKHQGGWTDGGSGGGGGYQDGGYRDSGFQPGGYHGGHSSGGYQGGGYGGFQTSSSYTGSGYQGGGYQQDNRYQDGGHHGDRGGGRGGRGGRGGRGGRAGQGGGWGGRGSQNYHQGGQFEQHFQHGGYQYNHSGFGQGRHYTS

SEQ ID NO: 898586 - protein, 546 aa, Homo sapiens; identical to SEQ ID NO: 898585

SEQ ID NO: 898587 - protein, 162 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDARRWS

SEQ ID NO: 898588 - protein, 162 aa, Homo sapiens; identical to SEQ ID NO: 898587

SEQ ID NO: 898589 - protein, 123 aa, Homo sapiens
EDGRAGLGVRGERVGGGQVKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDARRWS

SEQ ID NO: 898590 - protein, 162 aa, Homo sapiens; identical to SEQ ID NO: 898587

SEQ ID NO: 898591 - protein, 162 aa, Homo sapiens; identical to SEQ ID NO: 898587

SEQ ID NO: 898592 - protein, 162 aa, Homo sapiens; identical to SEQ ID NO: 898587

SEQ ID NO: 898593 - protein, 162 aa, Homo sapiens; identical to SEQ ID NO: 898587

SEQ ID NO: 898594 - protein, 162 aa, Homo sapiens; identical to SEQ ID NO: 898587

SEQ ID NO: 898595 - protein, 162 aa, Homo sapiens; identical to SEQ ID NO: 898587

SEQ ID NO: 898596 - protein, 233 aa, Homo sapiens [sequence omitted]

SEQ ID NO: 898597 - protein, 162 aa, Homo sapiens; identical to SEQ ID NO: 898587

SEQ ID NO: 898598 - protein, 162 aa, Homo sapiens; identical to SEQ ID NO: 898587

SEQ ID NO: 898599 - protein, 162 aa, Homo sapiens; identical to SEQ ID NO: 898587

SEQ ID NO: 898600 - protein, 162 aa, Homo sapiens; identical to SEQ ID NO: 898587

SEQ ID NO: 898601 - protein, 162 aa, Homo sapiens; identical to SEQ ID NO: 898587

SEQ ID NO: 898602 - protein, 162 aa, Homo sapiens; identical to SEQ ID NO: 898587

SEQ ID NO: 898603 - protein, 162 aa, Homo sapiens; identical to SEQ ID NO: 898587

SEQ ID NO: 898604 - protein, 162 aa, Homo sapiens; identical to SEQ ID NO: 898587

SEQ ID NO: 898605 - protein, 1259 aa, Homo sapiens
DLFHDDKDPVPATTPGKGSSSKISVRSARPPMKVSNKEHKKTVGHQFRTSLHLLMETLNATTPHYVRCIKPNDEKLPFHFDPKRAVQQLRACGVLETIRISAAGYPSRWAYHDFFNRYRVLVKKRELANTDKKAICRSVLENLIKDPDKFQFGRTKIFFRAGQVAYLEKLRADKFRTATIMIQKTVRGWLQKVKYHRLKGATLTLQRYCRGHLARRLAEHLRRIRAAVVLQKHYRMQRARQAYQRVRRAAVVIQAFTRAMFVRRTYRQVLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNSKTEDWGYLNEDGELGLAYQGLKQVARLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 898606 - protein, 619 aa, Homo sapiens
VACSSWKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNRLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 898607 - protein, 288 aa, Homo sapiens
WFQTGRRGQWITQNVISKSSCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 898608 - protein, 145 aa, Homo sapiens
LSDLNGKVTRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 898609 - protein, 1233 aa, Homo sapiens
DLFHDDKDPVPATTPGKGSSSKISVRSARPPMKVSNKEHKKTVGHQFRTSLHLLMETLNATTPHYVRCIKPNDEKLPFHFDPKRAVQQLRACGVLETIRISAAGYPSRWAYHDFFNRYRVLVKKRELANTDKKAICRSVLENLIKDPDKFQFGRTKIFFRAGQVAYLEKLRADKFRTATIMIQKTVRGWLQKVKYHRLKGATLTLQRYCRGHLARRLAEHLRRIRAAVVLQKHYRMQRARQAYQRVRRAAVVIQAFTRAMFVRRTYRQVLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNRLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 898610 - protein, 418 aa, Homo sapiens
MKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 898611 - protein, 1233 aa, Homo sapiens; identical to SEQ ID NO: 898609

SEQ ID NO: 898612 - protein, 582 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRAGEIRGWEGKSLFPQWPREFPNGPQTLGFGMCFVWGFPKHKDVPL

SEQ ID NO: 898613 - protein, 631 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAAASCSALGTMPAPMVVSGKRPAKTPSRPTMPRLKSSPSLKAAPT

SEQ ID NO: 898614 - protein, 631 aa, Homo sapiens; identical to SEQ ID NO: 898613

SEQ ID NO: 898615 - protein, 652 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAAASCSALGTMPAPMVVSGKGMASQAGQVGSPHRAESPESPTKSLRSPPPLRPWPPSPLPWMHPHF

SEQ ID NO: 898616 - protein, 121 aa, Homo sapiens
MRQRAPRRQRKQQANDKKQRQKRTDEARAKKGEATRQAAGKAEDTEQTARETKRREETQKRNNGKRSDKTREQTRRGRRAQQTEKTAKTKQAGERAEQGEKNEEKQRRGGGRPREETTPQN

SEQ ID NO: 898617 - protein, 354 aa, Homo sapiens
MISSVCVSSYRGRKSGNKPPSKTCLKEEMAKGEASEKIIINFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAAASCSALGTMPAPMVVSGKRPAKTPSRPTMPRLKSSPSLKAAPT

SEQ ID NO: 898618 - protein, 641 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAAASCSALGTMPAPMVVSGKGHWPRDFLLITECASCGLSAWRVATGYQAFRRRSG

SEQ ID NO: 898619 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 898620 - protein, 384 aa, Homo sapiens; identical to SEQ ID NO: 898619

SEQ ID NO: 898621 - protein, 384 aa, Homo sapiens; identical to SEQ ID NO: 898619

SEQ ID NO: 898622 - protein, 142 aa, Homo sapiens
MKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENGGRMGKGIFTRLQ

SEQ ID NO: 898623 - protein, 349 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKLGTPCPEFMKKLQPTVRTYVENRPKYAGYSFEKLFPDVLFPADSEHNKLKASQARDLLSKMLVIDASKRISVDEALQHPYINVWYDPSEAEAVSYFLNVYRTYCILRVRMTVRFGGDLLILNKNVDT

SEQ ID NO: 898624 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 898625 - protein, 169 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRVSRRNYRHTLCFLIEVKFM

SEQ ID NO: 898626 - protein, 384 aa, Homo sapiens; identical to SEQ ID NO: 898619

SEQ ID NO: 898627 - protein, 384 aa, Homo sapiens; identical to SEQ ID NO: 898619

SEQ ID NO: 898628 - protein, 218 aa, Homo sapiens [sequence omitted]

SEQ ID NO: 898629 - protein, 218 aa, Homo sapiens [sequence omitted]

SEQ ID NO: 898630 - protein, 218 aa, Homo sapiens [sequence omitted]

SEQ ID NO: 898631 - protein, 753 aa, Homo sapiens
AGQPRRGSALRAWRCGAAALATFPAPALPGLMYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKGPFGAGQRPWPGVPRLLEPGSTPSREPHPVERSGVPALTSSWASGCPRPLHPALQLVIDSAFGGRSV

SEQ ID NO: 898632 - protein, 224 aa, Homo sapiens
MTSSTSDHHLDAAAARQPNGVCRAGFERQHSLPSSEHLGADGGLYQIPLPSSQIPPQPRRAAPTTPPPPVKRRDREALMASGSGGKNLPSGVIWVHGSSVSSTSWKALYSSSPFDKIQVLNHTPLVPRPHPPFHSNPSTSITMTPWAREMATVIHRLLGTETRCHVAAASSAAIGRCVTLDSSQLSPDPQPQRNEQHLACPECASYVADSTRQRPAPHAMAYSG

SEQ ID NO: 898633 - protein, 746 aa, Homo sapiens
AGQPRRGSALRAWRCGAAALATFPAPALPGLMYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 898634 - protein, 746 aa, Homo sapiens; identical to SEQ ID NO: 898633

SEQ ID NO: 898635 - protein, 719 aa, Homo sapiens
AGQPRRGSALRAWRCGAAALATFPAPALPGLMYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 898636 - protein, 774 aa, Homo sapiens
AGQPRRGSALRAWRCGAAALATFPAPALPGLMYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPGGVGPGWAVAEHMVALRLSTLSIPMSFLAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 898637 - protein, 746 aa, Homo sapiens; identical to SEQ ID NO: 898633

SEQ ID NO: 898638 - protein, 753 aa, Homo sapiens
AGQPRRGSALRAWRCGAAALATFPAPALPGLMYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 898639 - protein, 442 aa, Homo sapiens
AGQPRRGSALRAWRCGAAALATFPAPALPGLMYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKVRVGGTAGPPCYPPCSHRHTLVQPVHYRYFSSSGSELLLCWALGTLS

SEQ ID NO: 898640 - protein, 263 aa, Homo sapiens
AGQPRRGSALRAWRCGAAALATFPAPALPGLMYRALYAFRSAEPNALAFAAGETFLVLERSSAHWWLAARARSGETGYVPPAYLRRLQVYTAVPCPPQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGTKPLPPGVTLCTSESSVQRQL

SEQ ID NO: 898641 - protein, 707 aa, Homo sapiens
RRARGAAGRAAARGGRGQARGLHGPRLRRPRGLEGTRSAAGAAQRPGPRSTLRKLVFLRSALRAGYIVLLRWPGEVAADLPSPPDSGRAATPASHWREAGGGEGVGEWRRGGGGVLPFNPPQEVVPLSPKAEGPSWGWVRAEGTDPFRAVPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 898642 - protein, 391 aa, Homo sapiens
LATKHTLLGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 898643 - protein, 355 aa, Homo sapiens [sequence omitted]

SEQ ID NO: 898644 - protein, 169 aa, Homo sapiens
NIWHGTRLGGAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898645 - protein, 371 aa, Homo sapiens
RQGAVPRVAGRGRGGARMEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898646 - protein, 354 aa, Homo sapiens
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898647 - protein, 371 aa, Homo sapiens; identical to SEQ ID NO: 898645

SEQ ID NO: 898648 - protein, 371 aa, Homo sapiens; identical to SEQ ID NO: 898645

SEQ ID NO: 898649 - protein, 337 aa, Homo sapiens
RQGAVPRVAGRGRGGARMEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898650 - protein, 251 aa, Homo sapiens
MCPTSSLRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898651 - protein, 406 aa, Homo sapiens
TPKNRLGTRLGVGRGGARMEVEAVCGGAGEVEAQDSDPAPAFSKAPGSAGHYELPWVEKYRPVKLNEIVGNEDTVSRLEVFAREGNVPNIIIAGSEVTEMQTAVNITQELPEVLLVVGSLYWRSHSQGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898652 - protein, 169 aa, Homo sapiens; identical to SEQ ID NO: 898644

SEQ ID NO: 898653 - protein, 163 aa, Homo sapiens
TPKNRLGTRLGVGRGGARMEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADR

SEQ ID NO: 898654 - protein, 354 aa, Homo sapiens; identical to SEQ ID NO: 898646

SEQ ID NO: 898655 - protein, 354 aa, Homo sapiens; identical to SEQ ID NO: 898646

SEQ ID NO: 898656 - protein, 354 aa, Homo sapiens; identical to SEQ ID NO: 898646

SEQ ID NO: 898657 - protein, 338 aa, Homo sapiens
TPKNRLGTRLGVGRGGARMEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898658 - protein, 321 aa, Homo sapiens
RQGAVPRVAGRGRGGARMEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKGWPPSPRPGRGTAHFLGRGEREPF

SEQ ID NO: 898659 - protein, 253 aa, Homo sapiens
MLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 898660 - protein, 331 aa, Homo sapiens
RQGAVPRVAGRGRGGARMEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNWVTSQDWFLPVSTCSRSVKSPPCGRVVPWCALGASGWSWGGPRILASGIKGPGSGPKGLGAGETGASSSGLLLPPGVLP

SEQ ID NO: 898661 - protein, 277 aa, Homo sapiens
KGRAGPAGARPCGSQDSSPGASSPYATRNPSQGPGDSGGVGQDRGGGAQQRPPAPPKAGRSSEPGAGPARGFPEGPAQPEGGTEGGASAGAATKACATLRGAGELGGEPGACQARAAAASDRRARRVDLRSPRPATMTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 898662 - protein, 141 aa, Homo sapiens
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 898663 - protein, 141 aa, Homo sapiens; identical to SEQ ID NO: 898662

SEQ ID NO: 898664 - protein, 277 aa, Homo sapiens; identical to SEQ ID NO: 898661

SEQ ID NO: 898665 - protein, 181 aa, Homo sapiens
MTIMVEDIMKLLCSLSGERKMKAAVKHSGKGALVTGAMAFVGGLVGGPPGLAVGSSLRHRIALNRLLSYLLWPLTLSQTCLVHSLDSFEEYWAGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 898666 - protein, 243 aa, Homo sapiens
KGRAGPAGARPCGSQDSSPGASSPYATRNPSQGPGDSGGVGQDRGGGAQQRPPAPPKAGRSSEPGAGPARGFPEGPAQPEGGTEGGASAGAATKACATLRGAGELGGEPGACQARAAAASDRRARRVDLRSPRPATMTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRPCSSSCWPCW

SEQ ID NO: 898667 - protein, 277 aa, Homo sapiens; identical to SEQ ID NO: 898661

SEQ ID NO: 898668 - protein, 149 aa, Homo sapiens
KGRAGPAGARPCGSQDSSPGASSPYATRNPSQGPGDSGGVGQDRGGGAQQRPPAPPKAGRSSEPGAGPARGFPEGPAQPEGGTEGGASAGAATKACATLRGAGELGGEPGACQARAAAASDRRARRVDLRSPRGGCRGAVRCLDDKWTV

SEQ ID NO: 898669 - protein, 277 aa, Homo sapiens; identical to SEQ ID NO: 898661

SEQ ID NO: 898670 - protein, 277 aa, Homo sapiens; identical to SEQ ID NO: 898661

SEQ ID NO: 898671 - protein, 317 aa, Homo sapiens
KGRAGPAGARPCGSQDSSPGASSPYATRNPSQGPGDSGGVGQDRGGGAQQRPPAPPKAGRSSEPGAGPARGFPEGPAQPEGGTEGGASAGAATKACATLRGAGELGGEPGACQARAAAASDRRARRVDLRSPRPATMTIMVEDIMKLLCSLSGERKMKAAVKHSGKGALVTGAMAFVGGLVGGPPGLAVGSSLRHRIALNRLLSYLLWPLTLSQTCLVHSLDSFEEYWAGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 898672 - protein, 88 aa, Homo sapiens
KICSLHSLPPPPTSGQFKPVPQILMELPPAEQQRLFNEAAAIIRHLEWTDAVQLTALVMGSEALQQQLLAMLVNYVTKELRAEIQYDD

SEQ ID NO: 898673 - protein, 277 aa, Homo sapiens; identical to SEQ ID NO: 898661

SEQ ID NO: 898674 - protein, 378 aa, Homo sapiens [sequence omitted]

SEQ ID NO: 898675 - protein, 354 aa, Homo sapiens
MRAAAAPGLTAPWRLLQCCELEAGELGMAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGNFMRIYRLSPLAVRTSLVISSLHVTTSPA

SEQ ID NO: 898676 - protein, 378 aa, Homo sapiens [sequence omitted]

SEQ ID NO: 898677 - protein, 378 aa, Homo sapiens [sequence omitted]

SEQ ID NO: 898678 - protein, 378 aa, Homo sapiens [sequence omitted]

SEQ ID NO: 898679 - protein, 354 aa, Homo sapiens; identical to SEQ ID NO: 898675

SEQ ID NO: 898680 - protein, 382 aa, Homo sapiens
MRAAAAPGLTAPWRLLQCCELEAGELGMAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETDLGSLQPLPPGFKLFSCLSLPSSWDYRLLPPLLANFCIFSGDGVLPCWAGWSRTPDLT

SEQ ID NO: 898681 - protein, 274 aa, Homo sapiens
MRAAAAPGLTAPWRLLQCCELEAGELGMAVPAAAMGPSALGQSGPGSMAPWCSVSSGPSRYVLGMQELFRGHSKTREFLAHSAKVHSVAFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETGDKLWEVQCESPTFTVAWHPKRPLLAFACDDKDGKYDSSREAGTVKLFGLPNDS

SEQ ID NO: 898682 - protein, 378 aa, Homo sapiens [sequence omitted]

SEQ ID NO: 898683 - protein, 378 aa, Homo sapiens [sequence omitted]

SEQ ID NO: 898684 - protein, 378 aa, Homo sapiens [sequence omitted]

SEQ ID NO: 898685 - protein, 378 aa, Homo sapiens [sequence omitted]

SEQ ID NO: 898686 - protein, 359 aa, Homo sapiens
MRAAAAPGLTAPWRLLQCCELEAGELGMAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSRLDWPVRTLSFSHDGKMLASASEDHFIDIAEVETVQQTHSASQKAAGPLAKRPVCSIVIIPPSLLPFES

SEQ ID NO: 898687 - protein, 302 aa, Homo sapiens
MRAAAAPGLTAPWRLLQCCELEAGELGMAVPAAAMGPSALGQSGPGSMAPWCSVSSGPSRYVLGMQELFRGHSKTREFLAHSAKVHSVAWSCDGRRLASGSFDKTASVFLLEKDRLVKENNYRGHGDSVDQLCWHPSNPDLFVTASGDKTIRIWDVRTTKCIATVNTKGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCVRCFSSWMAFRTSQLSP

SEQ ID NO: 898688 - protein, 64 aa, Homo sapiens
MFLQYYLNEQGDRVYTLKKFDPMGQQTCSAHPARFSPDDKYSRHRITIKKRFKVLMTQQPRPVL

SEQ ID NO: 898689 - protein, 64 aa, Homo sapiens; identical to SEQ ID NO: 898688

SEQ ID NO: 898690 - protein, 64 aa, Homo sapiens; identical to SEQ ID NO: 898688

SEQ ID NO: 898691 - protein, 69 aa, Homo sapiens
IRFIAHIGIGLRQDRHEGPLQTERWTELGPLAYKRSCFSSITQPILLGSPQMTNTLDTESPSRNASRCS

SEQ ID NO: 898692 - protein, 111 aa, Homo sapiens
MAGGLATQTTFLHERQEVLNTYDKHLSIRARGAGSINRRIPTHNSRNTPYHRQQEVQISYARPRIWTPPPNFLQHQQHVCYRDINVTGSSNATATHHCSSKNVNHRICNHT

SEQ ID NO: 898693 - protein, 81 aa, Homo sapiens
DHCRLSGGPNWDRWLISDHVSPVLPQRAGRSSLYAEGEERKQGVNRHGEKCRWEEWVRSYVELPSWVRGTRKSRTEVGKNR

SEQ ID NO: 898694 - protein, 64 aa, Homo sapiens; identical to SEQ ID NO: 898688

SEQ ID NO: 898695 - protein, 64 aa, Homo sapiens; identical to SEQ ID NO: 898688

SEQ ID NO: 898696 - protein, 415 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 898697 - protein, 415 aa, Homo sapiens; identical to SEQ ID NO: 898696

SEQ ID NO: 898698 - protein, 375 aa, Homo sapiens
KPLARYEAWCAQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 898699 - protein, 310 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGEVH

SEQ ID NO: 898700 - protein, 406 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 898701 - protein, 364 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDGFFCWASLSFSSAAT

SEQ ID NO: 898702 - protein, 336 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAW

SEQ ID NO: 898703 - protein, 310 aa, Homo sapiens; identical to SEQ ID NO: 898699

SEQ ID NO: 898704 - protein, 166 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATILFRLG

SEQ ID NO: 898705 - protein, 239 aa, Homo sapiens
RCFPCRGEGSDYNSQRVWRPQQWAVEFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEGEARSLQVDWEPPDSPLCLPAPLRCDGNWG

SEQ ID NO: 898706 - protein, 111 aa, Homo sapiens
NEVKSVAWAPSGNLLATCSRDKSVWVWEGEARSLQVDWEPPDSPLCVPDRVGSWVPFFSPTVDEEDEYECVSVLNSHTQDVKHVVWHPSQEVRVKQGLLWEGLWCAGLCPA

SEQ ID NO: 898707 - protein, 415 aa, Homo sapiens; identical to SEQ ID NO: 898696

SEQ ID NO: 898708 - protein, 310 aa, Homo sapiens; identical to SEQ ID NO: 898699

SEQ ID NO: 898709 - protein, 389 aa, Homo sapiens
RCFPCRGEGSDYNSQRVWRPQQWAVEFPGRPRSSGGSGSLCRPRKPGVGGTQTRAVRPAVCSADSARPHLPLRRADMKDLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 898710 - protein, 311 aa, Homo sapiens [sequence omitted]

SEQ ID NO: 898711 - protein, 336 aa, Homo sapiens; identical to SEQ ID NO: 898702

SEQ ID NO: 898712 - protein, 183 aa, Homo sapiens
MLCHPVILFLPVQLHCVIKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 898713 - protein, 144 aa, Homo sapiens
RCFPCRGEGSDYNSQRVWRPQQWAVEFPGRPRSSGGSGSLCRPRKPGVGGTQTRAVRPAVCSADSARPHLPLRWFLAWNPAGTLLASCGGDRRIRIWGTEGDSWICKSVLSEGHQRTVRKVAWSPCGNYLASASFDATILFRLG

SEQ ID NO: 898714 - protein, 381 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 898715 - protein, 227 aa, Homo sapiens [sequence omitted]

SEQ ID NO: 898716 - protein, 327 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRRWCLILCATCGSHGTHRDCSSLRSNNYIPENSGDIPCCSSTFHPEEHFCRDNTLEENPGLSWTDWPEPSLLEKPESSRGRRSYSWRSKGVRITNSCKKSK

SEQ ID NO: 898717 - protein, 293 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGEHSGTVRQGSRASSETMSQAKRSLSGA

SEQ ID NO: 898718 - protein, 277 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQVGLFPPWVPSTIALVLCLEPENPGNAQVCLSFGAPCWRPVLRAGFRQLEESQSSLWSFLAYRTSHMIRFRISKIFSIARANGLIPE

SEQ ID NO: 898719 - protein, 342 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 898720 - protein, 342 aa, Homo sapiens; identical to SEQ ID NO: 898719

SEQ ID NO: 898721 - protein, 342 aa, Homo sapiens; identical to SEQ ID NO: 898719

SEQ ID NO: 898722 - protein, 342 aa, Homo sapiens; identical to SEQ ID NO: 898719

SEQ ID NO: 898723 - protein, 230 aa, Homo sapiens [sequence omitted]

SEQ ID NO: 898724 - protein, 261 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMPNFLREYKPFCDNIAQHSTPNMGMWGGKLQSIVVKTYPNSSVEN

SEQ ID NO: 898725 - protein, 170 aa, Homo sapiens
MPEIEILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDR

SEQ ID NO: 898726 - protein, 342 aa, Homo sapiens; identical to SEQ ID NO: 898719

SEQ ID NO: 898727 - protein, 342 aa, Homo sapiens; identical to SEQ ID NO: 898719

SEQ ID NO: 898728 - protein, 318 aa, Homo sapiens
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 898729 - protein, 224 aa, Homo sapiens
MLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNSKNFWTEGIDILNKRSDGSNSGLDMRGEYNNRGWYHVGFACPVFA

SEQ ID NO: 898730 - protein, 318 aa, Homo sapiens; identical to SEQ ID NO: 898728

SEQ ID NO: 898731 - protein, 347 aa, Homo sapiens
YMIKSSSVPEQFVFGGCVSCPQAVLDTGKMLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 898732 - protein, 318 aa, Homo sapiens; identical to SEQ ID NO: 898728

SEQ ID NO: 898733 - protein, 82 aa, Homo sapiens
FAALVSWRSPPLARPTREHRLQLEQPGQERNGVVRQRERKPVRGCAFLSPSRSRRGLECNGVISAHPNLHLPDRAIALQPGQ

SEQ ID NO: 898734 - protein, 318 aa, Homo sapiens; identical to SEQ ID NO: 898728

SEQ ID NO: 898735 - protein, 117 aa, Homo sapiens
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESIIRCPIS

SEQ ID NO: 898736 - protein, 140 aa, Homo sapiens
SLVLLSVPVGQAGMQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 898737 - protein, 140 aa, Homo sapiens; identical to SEQ ID NO: 898736

SEQ ID NO: 898738 - protein, 145 aa, Homo sapiens
DSTLPTLRVVLVILWQLLHVGPLRARVGTVHGLKEASSPAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 898739 - protein, 140 aa, Homo sapiens; identical to SEQ ID NO: 898736

SEQ ID NO: 898740 - protein, 110 aa, Homo sapiens [sequence omitted]

SEQ ID NO: 898741 - protein, 230 aa, Homo sapiens [sequence omitted]

SEQ ID NO: 898742 - protein, 230 aa, Homo sapiens [sequence omitted]

SEQ ID NO: 898743 - protein, 149 aa, Homo sapiens
TTTKFAPRRLETQAFLSQLWKEYAKGDSRYILGDNFTVCMETITACLWGPLSLWVVIAFLRQHPLRFILQLVVSVGQIYGDVLYFLTEHRDGFQHGELGHPLYFWFYFVFMNALWLVLPGVLVLDAVKHLTHAQSTLDAKATKAKSKKN

SEQ ID NO: 898744 - protein, 230 aa, Homo sapiens [sequence omitted]

SEQ ID NO: 898745 - protein, 230 aa, Homo sapiens [sequence omitted]

SEQ ID NO: 898746 - protein, 85 aa, Homo sapiens
PLPSRALVSALHPAPAPSPSSPRLRGQPSACQRETLCHPPPPPPFCACARPPATARLSRGQKIRLLIGQRDWRVLVRIDRLCVPF

SEQ ID NO: 898747 - protein, 154 aa, Homo sapiens [sequence omitted]

SEQ ID NO: 898748 - protein, 154 aa, Homo sapiens [sequence omitted]

SEQ ID NO: 898749 - protein, 154 aa, Homo sapiens [sequence omitted]

SEQ ID NO: 898750 - protein, 71 aa, Homo sapiens
MDSMFMSLEIIQQAVPVQVLTLILYPENTVGQRMKRVFEHFHYSSFKQGGGRPVFLKEFAVTSLEQYFFLA

SEQ ID NO: 898751 - protein, 154 aa, Homo sapiens [sequence omitted]

SEQ ID NO: 898752 - protein, 92 aa, Homo sapiens
HDLEVAQTTALPDEDDDLLRTKLEPRTAAYKTRLLTLPRVALQRLGFPLQSSEPGPRRGLASYGDEGRVRAEGRRPSCRASSISSRRKVMDQ

SEQ ID NO: 898753 - protein, 154 aa, Homo sapiens [sequence omitted]

SEQ ID NO: 898754 - protein, 154 aa, Homo sapiens [sequence omitted]

SEQ ID NO: 898755 - protein, 154 aa, Homo sapiens [sequence omitted]

SEQ ID NO: 898756 - protein, 33 aa, Homo sapiens
MLGDADRSGSRKLVSIDQESRSLSGMNHDKIAP

SEQ ID NO: 898757 - protein, 141 aa, Homo sapiens
HPNHHRHNPQTTARYEAGCAAASGVSVAVLGTRTSAWPSELWRRESNGPVKVWGSIKGLTEGLHGFHVHEFGDNTAGCTSAGPHFNPLSRKHGGPKDEERHVGDLGNVTADKDGVADVSIEDSVISLSGDHCIIGRTLVGP

SEQ ID NO: 898758 - protein, 42 aa, Homo sapiens
MATKAVCVLKGDGPVAGHHQFRAEVMDQCSADDSEYSMIRYR

SEQ ID NO: 898759 - protein, 70 aa, Homo sapiens
TPTTTATTHKLRLGTRLGVLQRLGFPLQSSEPGPRRGLASYGDEGRVRAEGRRPSCRASSISSRRKVMDQ

SEQ ID NO: 898760 - protein, 70 aa, Homo sapiens; identical to SEQ ID NO: 898759

SEQ ID NO: 898761 - protein, 31 aa, Homo sapiens
MAFGNNPPDGSSGGHRQGHSPKRVHTERNII

SEQ ID NO: 898762 - protein, 141 aa, Homo sapiens; identical to SEQ ID NO: 898757

SEQ ID NO: 898763 - protein, 154 aa, Homo sapiens [sequence omitted]

SEQ ID NO: 898764 - protein, 154 aa, Homo sapiens [sequence omitted]

SEQ ID NO: 898765 - protein, 154 aa, Homo sapiens [sequence omitted]

SEQ ID NO: 898766 - protein, 154 aa, Homo sapiens [sequence omitted]

SEQ ID NO: 898767 - protein, 154 aa, Homo sapiens [sequence omitted]

SEQ ID NO: 898768 - protein, 154 aa, Homo sapiens [sequence omitted]

SEQ ID NO: 898769 - protein, 345 aa, Homo sapiens
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRSAYDEPHLLVNIEKQKLELEKRRLDIEAERLQVEKERLQIEKERLRHLDMEHERLQLEKERLQIEREKLRLQIVNSEKPSLENELGQGEKSMLQPQDIETEKLKLERERLQLEKDRLQFLKFESEKLQIEKERLQVEKDRLRIQKEGHLQ

SEQ ID NO: 898770 - protein, 345 aa, Homo sapiens; identical to SEQ ID NO: 898769

SEQ ID NO: 898771 - protein, 345 aa, Homo sapiens; identical to SEQ ID NO: 898769

SEQ ID NO: 898772 - protein, 414 aa, Homo sapiens
CDRWSARGGRTAMSAEGAEPGPGSGSGPGPGPLCPEHGQALSWFCGSERRPVCAACAGLGGRCRGHRIRRAEERAEELRNKIVDQCERLQLQSAAITKYVADVLPGKNQRAVSMASAARELVIQRLSLVRSLCESEEQRLLEQVHGEEERAHQSILTQRVHWAEALQKLDTIRTGLVGMLTHLDDLQLIQKEQEIFERTEEAEGILDPQESEMLNFNEKCTRSPLLTQLWATAVLGSLSGTEDIRIDERTVSPFLQLSDDRKTLTFSTKKSKACADGPERFDHWPNALAATSFQNGLHAWMVNVQNSCAYKVGVASGHLPRKGSGSDCRLGHNAFSWVFSRYDQEFRFSHNGQHEPLGLLRGPAQLGVVLDLQVQELLFYEPASGTVLCAHHVSFPGPLFPVFAVADQTISIVR

SEQ ID NO: 898773 - protein, 414 aa, Homo sapiens; identical to SEQ ID NO: 898772

SEQ ID NO: 898774 - protein, 213 aa, Homo sapiens
CDRWSARGGRTAMSAEGAEPGPGSGSGPGPGPLCPEHGQALSWFCGSERRPVCAACAGLGGRCRGHRIRRAEERAEELRNKIVDQCERLQLQSAAITKYVADVLPGKNQRAVSMASAARELVIQRLSLVRSLCESEEQRLLEQVHGEEERAHQSILTQRVHWAEALQKLDTIRTGLVGMLTHLDDLQLIAQRTYGSMRGQSAPSCNCQMIERP

SEQ ID NO: 898775 - protein, 232 aa, Homo sapiens
CDRWSARGGRTAMSAEGAEPGPGSGSGPGPGPLCPEHGQALSWFCGSERRPVCAACAGLGGRCRGHRIRRAEERAEELRNKIVDQCERLQLQSAAITKYVADVLPGKNQRAVSMASAARELVIQRLSLVRSLCESEEQRLLEQVHGEEERAHQSILTQRVHWAEALQKLDTIRTGLVGMLTHLDDLQLIQKEQEIFERTEEAEGILDPQDFVSHTMGSTSPWGCCGAQPSWV

SEQ ID NO: 898776 - protein, 68 aa, Homo sapiens
GLRKRDRRKSIALSCWTGEEERAHQSILTQRVHWAEALQKLDTIRTGLVGMLTHLDDLQLISQARVRA

SEQ ID NO: 898777 - protein, 227 aa, Homo sapiens
TRGNNLDPFQRQNFKPKQGIDPRSEMLNFNEKCTRSPLLTQLWATAVLGSLSGTEDIRIDERTVSPFLQLSDDRKTLTFSTKKSKACADGPERFDHWPNALAATSFQNGLHAWMVNVQNSCAYKVGVASGHLPRKGSGSDCRLGHNAFSWVFSRYDQEFRFSHNGQHEPLGLLRGPAQLGVVLDLQVQELLFYEPASGTVLCAHHVSFPGPLFPVFAVADQTISIVR

SEQ ID NO: 898778 - protein, 414 aa, Homo sapiens; identical to SEQ ID NO: 898772

SEQ ID NO: 898779 - protein, 473 aa, Homo sapiens
RAPAPGPWRRRWRELLSEQRLRTERTWPRSPGLGRGAAAAGARTAGAGLLRLLLGCGALVGGLRPVTMTTPANAQNASKTWELSLYELHRTPQEAIMDGTEIAVSPRSLHSELMCPICLDMLKNTMTTKECLHRFCSDCIVTALRSGNKECPTCRKKLVSKRSLRPDPNFDALISKIYPSREEYEAHQDRVLIRLSRLHNQQALSSSIEEGLRMQAMHRAQRVRRPIPGSDQTTTMSGGEGEPGEGEGDGEDVSSDSAPDSAPGPAPKRPRGGGAGGSSVGTGGGGTGGVGGGAGSEDSGDRGGTLGGGTLGPPSPPGAPSPPEPGGEIELVFRPHPLLVEKGEYCQTRYVKTTGNATVDHLSKYLALRIALERRQQQEAGEPGGPGGGASDTGGPDGCGGEGGGAGGGDGPEEPALPSLEGVSEKQYTIYIAPGGGAFTTLNGSLTLELVNEKFWKVSRPLELCYAPTKDPK

SEQ ID NO: 898780 - protein, 349 aa, Homo sapiens
RAPAPGPWRRRWRELLSEQRLRTERTWPRSPGLGRGAAAAGARTAGAGLLRLLLGCGALVGGLRPVTMTTPANAQNASKTWELSLYELHRTPQEAIMDGTEIAVSPRSLHSELMCPICLDMLKNTMTTKECLHRFCSDCIVTALRSGNKECPTCRKKLVSKRSLRPDPNFDALISKIYPSREEYEAHQDRVLIRLSRLHNQQALSSSIEEGLRMQAMHRAQRVRRPIPGSDQTTTMSGGEGEPGEGEGDGEDVSSDSAPDSAPGPAPKRPRGGGAGGSSVGTGGGGTGGVGGGAGSEDSGDRGGTLGGGTLGPPSPPGAPSPPEPGGEIELVFRPHPLLVEKGEYCQTR

SEQ ID NO: 898781 - protein, 238 aa, Homo sapiens
MSGGEGEPGEGEGDGEDVSSDSAPDSAPGPAPKRPRGGGAGGSSVGTGGGGTGGVGGGAGSEDSGDRGGTLGGGTLGPPSPPGAPSPPEPGGEIELVFRPHPLLVEKGEYCQTRYVKTTGNATVDHLSKYLALRIALERRQQQEAGEPGGPGGGASDTGGPDGCGGEGGGAGGGDGPEEPALPSLEGVSEKQYTIYIAPGGGAFTTLNGSLTLELVNEKFWKVSRPLELCYAPTKDPK

SEQ ID NO: 898782 - protein, 377 aa, Homo sapiens
MDGTEIAVSPRSLHSELMCPICLDMLKNTMTTKECLHRFCSDCIVTALRSGNKECPTCRKKLVSKRSLRPDPNFDALISKIYPSREEYEAHQDRVLIRLSRLHNQQALSSSIEEGLRMQAMHRAQRVRRPIPGSDQTTTMSGGEGEPGEGEGDGEDVSSDSAPDSAPGPAPKRPRGGGAGGSSVGTGGGGTGGVGGGAGSEDSGDRGGTLGGGTLGPPSPPGAPSPPEPGGEIELVFRPHPLLVEKGEYCQTRYVKTTGNATVDHLSKYLALRIALERRQQQEAGEPGGPGGGASDTGGPDGCGGEGGGAGGGDGPEEPALPSLEGVSEKQYTIYIAPGGGAFTTLNGSLTLELVNEKFWKVSRPLELCYAPTKDPK

SEQ ID NO: 898783 - protein, 238 aa, Homo sapiens; identical to SEQ ID NO: 898781

SEQ ID NO: 898784 - protein, 119 aa, Homo sapiens
STGDKEAGVIDQDTGIPHGPPVPPAQPANKRTQMRTRGFYTKYLYEILLYCTEWGKTRPHLLPFLLPCNVPSIRGVGEGEEPSHSRPPTNNKRAFFLFEKKKATRKLEEPADSQQPQTW

SEQ ID NO: 898785 - protein, 106 aa, Homo sapiens
MLSCTLSPSAPANSVTSGGHTHVTPAVLDSSSDGTSVALQEPPPRLVGTQVSGPYLPSRSEGSEVRGDGAASASASACPLPPSGIRAAQGLQSQRRESTSRGVLTT

SEQ ID NO: 898786 - protein, 106 aa, Homo sapiens; identical to SEQ ID NO: 898785

SEQ ID NO: 898787 - protein, 106 aa, Homo sapiens; identical to SEQ ID NO: 898785

SEQ ID NO: 898788 - protein, 108 aa, Homo sapiens
MAPPVAERGLKSVVWQKIKATVFDDCKKEGEWKIMLLDEFTTKLLASCCKMTDLLEEGITVTDEDIRKQEERVQQVRKKLEEALMADILSRAADTEELDIEMDSGDEA

SEQ ID NO: 898789 - protein, 592 aa, Homo sapiens
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 898790 - protein, 323 aa, Homo sapiens
YQLFLITNKRRICSHQDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 898791 - protein, 440 aa, Homo sapiens
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGNGDNHFLISILLLIIKESLKTER

SEQ ID NO: 898792 - protein, 272 aa, Homo sapiens
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKQV

SEQ ID NO: 898793 - protein, 406 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898794 - protein, 244 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGRAPVTCPCGHSGPVSS

SEQ ID NO: 898795 - protein, 353 aa, Homo sapiens
MRTTFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898796 - protein, 298 aa, Homo sapiens
MESAEPTVEASRVAHEAGIAGVSAPEPEQPLRAEGHPGLRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898797 - protein, 416 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKFWGHKQQPEPASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898798 - protein, 406 aa, Homo sapiens; identical to SEQ ID NO: 898793

SEQ ID NO: 898799 - protein, 158 aa, Homo sapiens
METLGPLRPGQPLTVTSPSALILLLLAFSSVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898800 - protein, 158 aa, Homo sapiens; identical to SEQ ID NO: 898799

SEQ ID NO: 898801 - protein, 406 aa, Homo sapiens; identical to SEQ ID NO: 898793

SEQ ID NO: 898802 - protein, 406 aa, Homo sapiens; identical to SEQ ID NO: 898793

SEQ ID NO: 898803 - protein, 120 aa, Homo sapiens
LQAGRGGCAGVDGARGHRQAPLCSRMPCVSLSGGRSGRRQRVVSGVITCPELDPTSAQDAAVHGAPVAAPRGALVQFPLGPELSRLGFPQNSPLLCCCDSSFPRSQWEKQLFKIAKTIQA

SEQ ID NO: 898804 - protein, 92 aa, Homo sapiens
QFCPCFPKVEFTPLKRNQKRRPPGAAALELLDSPGFKELAKQPPAVVGPEVRGGASEAQGAEKPPGKQPAQRAQEASPRELSVGVFECLSPS

SEQ ID NO: 898805 - protein, 406 aa, Homo sapiens; identical to SEQ ID NO: 898793

SEQ ID NO: 898806 - protein, 326 aa, Homo sapiens
DPGSGEAELLSQQLLPMAPASVPSSLQGGLGACLGRKERRCRSAWGGCSRRWPQAQAPQGLFPPARPGRAAWWRVREDPGGGPSCKNWWGPRSPPSRGGGLLPFGCCVQSPVSCSLRLYPAAFPPAGEARAALCWPVLPLPTRVPWWSCRGAHVLPFLQASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898807 - protein, 406 aa, Homo sapiens; identical to SEQ ID NO: 898793

SEQ ID NO: 898808 - protein, 193 aa, Homo sapiens
RTHLAPLQSGRGVCVCTCVRGTPCFWILPGSSQRDGACRLACGGLLKLPVPRQGLPNLSSQSPSRVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 898809 - protein, 406 aa, Homo sapiens; identical to SEQ ID NO: 898793

SEQ ID NO: 898810 - protein, 406 aa, Homo sapiens; identical to SEQ ID NO: 898793

SEQ ID NO: 898811 - protein, 68 aa, Homo sapiens
ALRGDVKALPTWPHGSGGASGVTSDFTQFWPYQPSILGFRVSGQPQSVTASSDKAFEDWLNDDLGSYQ

SEQ ID NO: 898812 - protein, 194 aa, Homo sapiens
MAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 898813 - protein, 194 aa, Homo sapiens; identical to SEQ ID NO: 898812

SEQ ID NO: 898814 - protein, 194 aa, Homo sapiens; identical to SEQ ID NO: 898812

SEQ ID NO: 898815 - protein, 194 aa, Homo sapiens; identical to SEQ ID NO: 898812

SEQ ID NO: 898816 - protein, 194 aa, Homo sapiens
MSPCFFDVIVLDDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 898817 - protein, 194 aa, Homo sapiens; identical to SEQ ID NO: 898812

SEQ ID NO: 898818 - protein, 194 aa, Homo sapiens; identical to SEQ ID NO: 898812

SEQ ID NO: 898819 - protein, 210 aa, Homo sapiens
FFSKNATTSPPCAFHTLKAILWWCGGFSQGFLKSFSGTFPAPPPAGLPGCKASVLTLLKVRCQATERRVLQQCTGCGLWLLQVPWTTALGSTAPAAGLHGWLLNFDCSIVSIFMGDTGVGKSSIVCRFVQDHFDHNISPTIGASFMTKTVPCGNELHKFLIWDTAGQERAARSHPWTPMKMETMEQSKLRSQPCKPAAGAVDPRAVVHGT

SEQ ID NO: 898820 - protein, 126 aa, Homo sapiens
MAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIR

SEQ ID NO: 898821 - protein, 194 aa, Homo sapiens; identical to SEQ ID NO: 898812

SEQ ID NO: 898822 - protein, 194 aa, Homo sapiens; identical to SEQ ID NO: 898812

SEQ ID NO: 898823 - protein, 297 aa, Homo sapiens
FFSKNATTSPPCAFHTLKAILWWCGGFSQGFLKSFSGTFPAPPPAGLPGCKASVLTLLKVRCQATERRVLQQCTGCGLWLLQVPWTTALGSTAPAAGLHGWLLNFDCSIVSIFMGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 898824 - protein, 194 aa, Homo sapiens; identical to SEQ ID NO: 898812

SEQ ID NO: 898825 - protein, 152 aa, Homo sapiens [sequence omitted]

SEQ ID NO: 898826 - protein, 194 aa, Homo sapiens; identical to SEQ ID NO: 898812

SEQ ID NO: 898827 - protein, 321 aa, Homo sapiens
LHRRLGPSNQAVRLHSSCPCSSGWRTEDRTLKPQVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898828 - protein, 475 aa, Homo sapiens
HEEGTGRDRRSPGRGHGNREAWGRPPPAPHARCQRAEACISLYGQMNGGVSRGRELRSAPLGRQRSRSHQPPAPSSPVRESPARCGAVSTSNPLRPGGRPRGLATRARKWGPNPVRDPRRGEQSRSWGDWLLKTVSSWRLGWHFDFGVRSLALSPRLECSGTISAHCKLYLLVHAILLPQPPKELGLQVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898829 - protein, 420 aa, Homo sapiens
HEEGTGRDRRSPGRGHGNREAWGRPPPAPHARCQRAEACISLYGQMTRRGFSRAGAAQRSTRPAAEPQPPAARALQPRPGVPGPLRCREYLQPPAPRREAEGLSHQGSEVGAESGARPKERGAEPELGRLVAENAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898830 - protein, 279 aa, Homo sapiens
MTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898831 - protein, 279 aa, Homo sapiens; identical to SEQ ID NO: 898830

SEQ ID NO: 898832 - protein, 293 aa, Homo sapiens
MQQEKSSLVLIDFSSEVVLGHECGCARVPRPNFFPCLPCRFARGPYAVGPSPPVLPLTVLCGLAPQDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898833 - protein, 375 aa, Homo sapiens
HEEGTGRDRRSPGRGHGNREAWGRPPPAPHARCQRAEACISLYGQMNGGVSRGRELRSAPLGRQRSRSHQPPAPSSPVRESPARCGAVSTSNPLRPGGRPRGLATRARKWGPNPVRDPRRGEQSRSWGDWLLKTVSSWRLGWHFDFGVAEKPGVKMTERFDCHHCNESLFGKKYILREESPYCVVCFETLFANTCEECGKPIGCDCSTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898834 - protein, 420 aa, Homo sapiens; identical to SEQ ID NO: 898829

SEQ ID NO: 898835 - protein, 420 aa, Homo sapiens; identical to SEQ ID NO: 898829

SEQ ID NO: 898836 - protein, 386 aa, Homo sapiens
HEEGTGRDRRSPGRGHGNREAWGRPPPAPHARCQRAEACISLYGQMTRRGFSRAGAAQRSTRPAAEPQPPAARALQPRPGVPGPLRCREYLQPPAPRREAEGLSHQGSEVGAESGARPKERGAEPELGRLVAENAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISDWWHNHFFEEGGYDGS

SEQ ID NO: 898837 - protein, 389 aa, Homo sapiens
HEEGTGRDRRSPGRGHGNREAWGRPPPAPHARCQRAEACISLYGQMTRRGFSEGGSCAALHSAGSGAAATSRPRPPAPSGSPRPAAVPSVSSWRLGWHFDFGVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898838 - protein, 87 aa, Homo sapiens
AAQKVGAIQPGSPPAQQLSLLIGLEDRRQNPKTTGKGHWFPCALLSPLPSFPACLCSSSVGILLHAEGVSSPGRKLSGTGSSLTPAE

SEQ ID NO: 898839 - protein, 434 aa, Homo sapiens
HEEGTGRDRRSPGRGHGNREAWGRPPPAPHARCQRAEACISLYGQMNGGVSRGRELRSAPLGRQRSRSHQPPAPSSPVRESPARCGAVSTSNPLRPGGRPRGLATRARKWGPNPVRDPRRGEQSRSWGDWLLKTVSSWRLGWHFDFGVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898840 - protein, 297 aa, Homo sapiens
AAQKVGAIQPGSPPAQQLSLLIGLEDRRQNPKTTGKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898841 - protein, 347 aa, Homo sapiens
LHRRLGPSNQAVRLHSSCPCSSGWRTEDRTLKPQVAEKPGVKMTERFDCHHCNESLFGKKYILREESPYCVVCFETLFANTCEECGKPIGCDCKDKHESSATRLPSPAQALCLTCCVALEDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 898842 - protein, 420 aa, Homo sapiens; identical to SEQ ID NO: 898829

SEQ ID NO: 898843 - protein, 420 aa, Homo sapiens; identical to SEQ ID NO: 898829

SEQ ID NO: 898844 - protein, 495 aa, Homo sapiens
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQLSSQKSVPWVPILKSLPLWAIVVAHFSYNWTFYTLLTLLPTYMKEILRFNVQENGFLSSLPYLGSWLCMILSGQAADNLRAKWNFSTLCVRRIFSLIGMIGPAVFLVAAGFIGCDYSLAVAFLTISTTLGGFCSSGFSINHLDIAPSYAGILLGITNTFATIPGMVGPVIAKSLTPDNTVGEWQTVFYIAAAINVFGAIFFTLFAKGEVQNWALNDHHGHRH

SEQ ID NO: 898845 - protein, 311 aa, Homo sapiens
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQVWTLTHFKNNVRNFFSSELRYQFLKIYIPIVHALDKVE

SEQ ID NO: 898846 - protein, 98 aa, Homo sapiens
MARRARTARLFYRAPHGPKPVSGGVVQGLRVGSGTGGGGLWAGMARVPAPCAGGTGAAQARGDIKRGARSECRSVPPASVRRSPSGTPGAATVIAEPS

SEQ ID NO: 898847 - protein, 495 aa, Homo sapiens; identical to SEQ ID NO: 898844

SEQ ID NO: 898848 - protein, 442 aa, Homo sapiens
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQNGFLSSLPYLGSWLCMILSGQAADNLRAKWNFSTLCVRRIFSLIGMIGPAVFLVAAGFIGCDYSLAVAFLTISTTLGGFCSSGFSINHLDIAPSYAGILLGITNTFATIPGMVGPVIAKSLTPDNTVGEWQTVFYIAAAINVFGAIFFTLFAKGEVQNWALNDHHGHRH

SEQ ID NO: 898849 - protein, 222 aa, Homo sapiens
GLGTAGLGAGAHSGKRPPPGPRRARRGEGGRGRALREGEAARTGSRTAPAGLQRPRTKAAMGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 898850 - protein, 154 aa, Homo sapiens
MSRSTQGKHSRSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 898851 - protein, 172 aa, Homo sapiens
GLGTAGLGAGAHSGKRPPPGPRRARRGEGGRGRALREGEAARTGSRTAPAGLQRPRTKAAMGLETEKADVQLFMDDDSYSHHSGLEYADPEKFADSDQDRDPHRLNSHLKDFNAFCKDLPNGSAFSADNMEECDRCYHCSIVYERRTMLLFCQPATEPGLNTWTPGLEIGIL

SEQ ID NO: 898852 - protein, 222 aa, Homo sapiens; identical to SEQ ID NO: 898849

SEQ ID NO: 898853 - protein, 166 aa, Homo sapiens
QEFLARFLCAHRDPKRRGGRPGTSFPPASPAQSAPGSRGVRWLTVRGPCVLSPQLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 898854 - protein, 222 aa, Homo sapiens; identical to SEQ ID NO: 898849

SEQ ID NO: 898855 - protein, 37 aa, Homo sapiens
GWMLKMTQTQEQDSGLYSCLASNEAGEARRNFSVEVL

SEQ ID NO: 898856 - protein, 239 aa, Homo sapiens
MGGCRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADSLPQGTKVDLLNPLKIQKGSTDTCWEGGHSRAGTGGGSPVSLLGWWTRGKKGARRPYGPRGWQAAGPPCLKGTSGG

SEQ ID NO: 898857 - protein, 486 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898858 - protein, 486 aa, Homo sapiens; identical to SEQ ID NO: 898857

SEQ ID NO: 898859 - protein, 486 aa, Homo sapiens; identical to SEQ ID NO: 898857

SEQ ID NO: 898860 - protein, 487 aa, Homo sapiens
MAPVVTGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898861 - protein, 465 aa, Homo sapiens
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898862 - protein, 465 aa, Homo sapiens; identical to SEQ ID NO: 898861

SEQ ID NO: 898863 - protein, 504 aa, Homo sapiens
MYICVFLLVLRIVSDSHNGYSFGVKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898864 - protein, 351 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQGENA

SEQ ID NO: 898865 - protein, 425 aa, Homo sapiens
MGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898866 - protein, 473 aa, Homo sapiens
DGACCGGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898867 - protein, 434 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898868 - protein, 382 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQVWREYALCRPRHFCIPRRLEMGPATSPGSSNFGPK

SEQ ID NO: 898869 - protein, 586 aa, Homo sapiens
SVRLDCPHWVHAQCRSRGPRQSCSAFNRFRAANSSSPGFGAPCGRQCWIWESLGKERAKEGKDGGLQSPRTSLKARPKTRITGALPMDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898870 - protein, 68 aa, Homo sapiens
DCLSIPLCWLGHIAVQQEQSFEPIQARCPLTNQTQTAREVTQTPAQIQPVSHHLQPQWYPNYRLFART

SEQ ID NO: 898871 - protein, 468 aa, Homo sapiens
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYT

SEQ ID NO: 898872 - protein, 94 aa, Homo sapiens
CKKSRRYRTGKPGRFPGKAASRIPYSAGGARRLALRGGGEGKGSAGAGWNRGVRKKGRGGGEGPGKASGGISRGLEFWREFVEDGACCDRSLKL

SEQ ID NO: 898873 - protein, 486 aa, Homo sapiens; identical to SEQ ID NO: 898857

SEQ ID NO: 898874 - protein, 486 aa, Homo sapiens; identical to SEQ ID NO: 898857

SEQ ID NO: 898875 - protein, 586 aa, Homo sapiens; identical to SEQ ID NO: 898869

SEQ ID NO: 898876 - protein, 500 aa, Homo sapiens
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898877 - protein, 465 aa, Homo sapiens; identical to SEQ ID NO: 898861

SEQ ID NO: 898878 - protein, 489 aa, Homo sapiens
MAWIKSTGNLVKRLHLKTNLLREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898879 - protein, 425 aa, Homo sapiens; identical to SEQ ID NO: 898865

SEQ ID NO: 898880 - protein, 460 aa, Homo sapiens [sequence omitted]

SEQ ID NO: 898881 - protein, 288 aa, Homo sapiens
FLYDAAVVLAMLVYCPDCRAPGDPLWFDCWCASWALWRGHDTGRGLSQTLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 898882 - protein, 586 aa, Homo sapiens; identical to SEQ ID NO: 898869

SEQ ID NO: 898883 - protein, 586 aa, Homo sapiens; identical to SEQ ID NO: 898869

SEQ ID NO: 898884 - protein, 260 aa, Homo sapiens [sequence omitted]

SEQ ID NO: 898885 - protein, 136 aa, Homo sapiens
QRRPRYRSGSEQAGGAIKTPAVCVRPQQPRRSADTQTPPARARTLSAPPFHWSRRAFRCASGGAPSAPPLQAGSVGAATVRPQPNALRCRLRSRAGRPRFWCLASELNNHHVEQKGKDQDHQEAPSACNIQCVCHV

SEQ ID NO: 898886 - protein, 136 aa, Homo sapiens; identical to SEQ ID NO: 898885

SEQ ID NO: 898887 - protein, 136 aa, Homo sapiens; identical to SEQ ID NO: 898885

SEQ ID NO: 898888 - protein, 136 aa, Homo sapiens; identical to SEQ ID NO: 898885

SEQ ID NO: 898889 - protein, 137 aa, Homo sapiens
SVPPRPPPVARLLAGPLPQVWPVRLAGPVRLAEKEARGRRWREEGCWRGPGPDVQGREAPVDGAGLGRRPAGEVAGSRPCVGRPCATWVTSDTWALDGPAARRPTPALPAPRRGPGGGLGPTRACSCGAPALCPTLS

SEQ ID NO: 898890 - protein, 183 aa, Homo sapiens
QRRPRYRSGSEQAGGAIKTPAVCVRPQQPRRSADTQTPPARARTLSAPPFHWSRRAFRCASGGAPSAPPLQAGSVGAATVRPQPNALRCRLRSRAGRPRFWCLASELNNHHVSMFAMFDQSQIQEFKEAFNMIDQNRDGFIDKEDLHDMLASLGKNPTDAYLDAMMNEAPGPIQFHHVPDHVW

SEQ ID NO: 898891 - protein, 136 aa, Homo sapiens; identical to SEQ ID NO: 898885

SEQ ID NO: 898892 - protein, 136 aa, Homo sapiens; identical to SEQ ID NO: 898885

SEQ ID NO: 898893 - protein, 136 aa, Homo sapiens; identical to SEQ ID NO: 898885

SEQ ID NO: 898894 - protein, 105 aa, Homo sapiens
MRPQGPFNFTMFLTMFGEKLNGTDPEDVIRNAFACFDEEATGTIQEDYLRELLTTMGDRFTDEEVDELYREAPIDKKGNFNYIGVHTHPETWSQRQKFRARGYRA

SEQ ID NO: 898895 - protein, 89 aa, Homo sapiens
GDRFTDEEVDELYREAPIDKRGISNYIEFTRILKHGAKDKDELKVTTMGDRFTDEEVDELYREAPIDKKGNFNYIRVHTHPETWSQRQR

SEQ ID NO: 898896 - protein, 136 aa, Homo sapiens; identical to SEQ ID NO: 898885

SEQ ID NO: 898897 - protein, 136 aa, Homo sapiens; identical to SEQ ID NO: 898885

SEQ ID NO: 898898 - protein, 136 aa, Homo sapiens; identical to SEQ ID NO: 898885

SEQ ID NO: 898899 - protein, 110 aa, Homo sapiens
MRPQGPFNFTMFLTMFGEKLNGTDPEDVIRNAFACFDEEATGTIQEDYLRELLTTMGDRFTDEEVDELYREAPIDKKGNFNYIGVHTHPETWSQRQQIPAKRSLLPLWVF

SEQ ID NO: 898900 - protein, 136 aa, Homo sapiens; identical to SEQ ID NO: 898885

SEQ ID NO: 898901 - protein, 137 aa, Homo sapiens; identical to SEQ ID NO: 898889

SEQ ID NO: 898902 - protein, 136 aa, Homo sapiens; identical to SEQ ID NO: 898885

SEQ ID NO: 898903 - protein, 80 aa, Homo sapiens
LWRQILMGQHTMGLPCGSTLQEFKEAFNMIDQNRDGFIDKEDLHDMLASLGKNPTDAYLDAMMNEAPGPIQFHHVPDHVW

SEQ ID NO: 898904 - protein, 136 aa, Homo sapiens; identical to SEQ ID NO: 898885

SEQ ID NO: 898905 - protein, 136 aa, Homo sapiens; identical to SEQ ID NO: 898885

SEQ ID NO: 898906 - protein, 74 aa, Homo sapiens
NGTMNLPQFYITNSILLGKFLPSEAQDIPATRRARRGQGKQVDELYREAPIDKKGNFNYIRVHTHPETWSQRQR

SEQ ID NO: 898907 - protein, 88 aa, Homo sapiens
DLPLPIPNFKGAESIRKHEQHMAFDQFFSGSIHAIVQTLVHFINPETVPKPCCAPTQLNAISVLYFDDSSNVILKKYRNMVVRACGCH

SEQ ID NO: 898908 - protein, 228 aa, Homo sapiens
MESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 898909 - protein, 598 aa, Homo sapiens
RPLVRSRAHKAGRAPRGPCYPRRRLEEGGLPPPEGESARGAGRRSARPPACLLAASPALALWTPRLAGCSSHPRPPPHSPFRSPGLLSKPCGAPGRVRGEGPGASTEQGAGVRAERGRPGRGHVWRGRSGARLQQVTERRGRPPAPSATWGGAGPEPGARVARRAGAMHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 898910 - protein, 598 aa, Homo sapiens; identical to SEQ ID NO: 898909

SEQ ID NO: 898911 - protein, 107 aa, Homo sapiens [sequence omitted]

SEQ ID NO: 898912 - protein, 107 aa, Homo sapiens [sequence omitted]

SEQ ID NO: 898913 - protein, 70 aa, Homo sapiens
EEVNSDHINNSETRHSHGENIRMCSHRDLVIHHILLTCLNNPSHLQLQMPLPLLLTLLLYSLHSIFLSIC

SEQ ID NO: 898914 - protein, 785 aa, Homo sapiens
MLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPQNLFLFSFSISDCVLNFRLLYLQAT

SEQ ID NO: 898915 - protein, 785 aa, Homo sapiens; identical to SEQ ID NO: 898914

SEQ ID NO: 898916 - protein, 785 aa, Homo sapiens; identical to SEQ ID NO: 898914

SEQ ID NO: 898917 - protein, 785 aa, Homo sapiens; identical to SEQ ID NO: 898914

SEQ ID NO: 898918 - protein, 785 aa, Homo sapiens; identical to SEQ ID NO: 898914

SEQ ID NO: 898919 - protein, 785 aa, Homo sapiens; identical to SEQ ID NO: 898914

SEQ ID NO: 898920 - protein, 72 aa, Homo sapiens
IISHGVSLVKIRGSSRSALDFSPIENSPGVNLMRSCTKSRIGVSEVMYVDLFIWLVQGESRISIYAPYLLDF

SEQ ID NO: 898921 - protein, 785 aa, Homo sapiens; identical to SEQ ID NO: 898914

SEQ ID NO: 898922 - protein, 708 aa, Homo sapiens
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPLYEGPSATGPEIIRSPQDDASSPHLQVMLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 898923 - protein, 708 aa, Homo sapiens; identical to SEQ ID NO: 898922

SEQ ID NO: 898924 - protein, 785 aa, Homo sapiens; identical to SEQ ID NO: 898914

SEQ ID NO: 898925 - protein, 785 aa, Homo sapiens; identical to SEQ ID NO: 898914

SEQ ID NO: 898926 - protein, 785 aa, Homo sapiens; identical to SEQ ID NO: 898914

SEQ ID NO: 898927 - protein, 510 aa, Homo sapiens
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPLYEGPSATGPEIIRSPQDDASSPHLQVMLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYLS

SEQ ID NO: 898928 - protein, 785 aa, Homo sapiens; identical to SEQ ID NO: 898914

SEQ ID NO: 898929 - protein, 641 aa, Homo sapiens; identical to SEQ ID NO: 882457

SEQ ID NO: 898930 - protein, 623 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKSACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 898931 - protein, 641 aa, Homo sapiens; identical to SEQ ID NO: 882457

SEQ ID NO: 898932 - protein, 622 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKWPRRTSLSTRGRSWSRCVTPSSADCTRVPVVPGLGASGLRVPREGLGQAPPLRR

SEQ ID NO: 898933 - protein, 641 aa, Homo sapiens; identical to SEQ ID NO: 882457

SEQ ID NO: 898934 - protein, 176 aa, Homo sapiens
MSHTCTGSPTPAPDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 898935 - protein, 132 aa, Homo sapiens
CRLLLLKFAAARAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 898936 - protein, 409 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAIQRTVPGCRWSRAWGLRGSGSQGRVWVRPHH

SEQ ID NO: 898937 - protein, 388 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRCFGTGLEHSSSNLVLLMTCRSRRPQTGSRSS

SEQ ID NO: 898938 - protein, 334 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKTLTHRGSRVGLEGQT

SEQ ID NO: 898939 - protein, 85 aa, Homo sapiens
CRLLLLKFAAARKVLDKCQEVISWLDANTLAEKDEFEHKRKELEQVCNPIISGLYQGAGGPGPGGFGAQGPKGGSGSGPTIEEVD

SEQ ID NO: 898940 - protein, 319 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSWSGAPPASPRCRSCCRTSSTGAT

SEQ ID NO: 898941 - protein, 555 aa, Homo sapiens
MKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 898942 - protein, 641 aa, Homo sapiens; identical to SEQ ID NO: 882457

SEQ ID NO: 898943 - protein, 607 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRWEERPSSPPTS

SEQ ID NO: 898944 - protein, 122 aa, Homo sapiens
DLEDPISGQDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 898945 - protein, 411 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGAWKDGPEGP

SEQ ID NO: 898946 - protein, 193 aa, Homo sapiens
MHAADLEKPMVEKQDQSPSLRTGEEKRDVSISRLREAFSLRHTTENKPHSPKTPEPRRSPLGQKRGMSSSSTSDAISDKGVLRPQKEAVSSSQGPSDPTDRAEVEKDSGHGSTSVDSEGFSIPDTGSHCSSECVASTPGDRGSQEHVDSQEKAPETDDSFSDVDCHSNQEDTGCKFQVLPQPTNLTSPNTKVF

SEQ ID NO: 898947 - protein, 193 aa, Homo sapiens; identical to SEQ ID NO: 898946

SEQ ID NO: 898948 - protein, 193 aa, Homo sapiens; identical to SEQ ID NO: 898946

SEQ ID NO: 898949 - protein, 193 aa, Homo sapiens; identical to SEQ ID NO: 898946

SEQ ID NO: 898950 - protein, 193 aa, Homo sapiens; identical to SEQ ID NO: 898946

SEQ ID NO: 898951 - protein, 193 aa, Homo sapiens; identical to SEQ ID NO: 898946

SEQ ID NO: 898952 - protein, 193 aa, Homo sapiens; identical to SEQ ID NO: 898946

SEQ ID NO: 898953 - protein, 193 aa, Homo sapiens; identical to SEQ ID NO: 898946

SEQ ID NO: 898954 - protein, 138 aa, Homo sapiens
MREENKGMPSGGGSDEGLASAAARGLVEKVRQLLEAGADPNGVNRFGRRAIQVMMMGSARVAELLLLHGAEPNCADPATLTRPVHDAAREGFLDTLVVLHRAGARLDVRDAWGRLPVDLAEERGHRDVAGYLRTATGD

SEQ ID NO: 898955 - protein, 138 aa, Homo sapiens; identical to SEQ ID NO: 898954

SEQ ID NO: 898956 - protein, 138 aa, Homo sapiens; identical to SEQ ID NO: 898954

SEQ ID NO: 898957 - protein, 179 aa, Homo sapiens
MREENKGMPSGGGSDEGLASAAARGLVEKVRQLLEAGADPNGVNRFGRRAIQVAGAPGPRRQGARERGARPRRIGAGTYIADVDLYRSLRWPEVMMMGSARVAELLLLHGAEPNCADPATLTRPVHDAAREGFLDTLVVLHRAGARLDVRDAWGRLPVDLAEERGHRDVAGYLRTATGD

SEQ ID NO: 898958 - protein, 726 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 898959 - protein, 643 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDETGQEREPGSGPAVCEFFSVALHIWSNILERKKLPQKSLAHLQSLHLLLQCRAQRRRQRQRAL

SEQ ID NO: 898960 - protein, 412 aa, Homo sapiens
MSEETVPEAASPPPPQGQPYFDRFSEDDPEYMRLRNRAADLRQDFNLMEQKKRVTMILQSPGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 898961 - protein, 560 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPCLRGLVPGAGLQDP

SEQ ID NO: 898962 - protein, 246 aa, Homo sapiens
MSEETVPEAASPPPPQGQPYFDRFSEDDPEYMRLRNRAADLRQDFNLMEQKKRVTMILQSPGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPCLRGLVPGAGLQDP

SEQ ID NO: 898963 - protein, 111 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNGFH

SEQ ID NO: 898964 - protein, 726 aa, Homo sapiens; identical to SEQ ID NO: 898958

SEQ ID NO: 898965 - protein, 203 aa, Homo sapiens
PTLKPHCDLRSPRGERKTRLDAPGWFSSETGQEREPGSGPAVCEFFSVALHIWSNIIGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 898966 - protein, 504 aa, Homo sapiens
MSEETVPEAASPPPPQGQPYFDRFSEDDPEYMRLRNRAADLRQDFNLMEQKKRVTMILQSPILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 898967 - protein, 420 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 898968 - protein, 254 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLPQEVLEMRNKIREQNRQDVKSAGPQSQLLASVIAEKSRSPVEQRLPLTGGETCLPCLRGLVPGAGLQDP

SEQ ID NO: 898969 - protein, 726 aa, Homo sapiens; identical to SEQ ID NO: 898958

SEQ ID NO: 898970 - protein, 726 aa, Homo sapiens; identical to SEQ ID NO: 898958

SEQ ID NO: 898971 - protein, 67 aa, Homo sapiens
KKGNNSSNIWALRQIADFMASTSHAVFPTSSMSMWCLGSCQEQRWRGGWGGEEREEQQEASGCQAME

SEQ ID NO: 898972 - protein, 102 aa, Homo sapiens
MESRSVAQAGVQWRVLSSLQAPSPGFTPFSCLSLPIAGITGPHHHAQLIFLFFVEMGFHHVGQAGLELLTSGDPPTSASQSAGITGVSHCTRPYLSKSFVPL

SEQ ID NO: 898973 - protein, 102 aa, Homo sapiens; identical to SEQ ID NO: 898972

SEQ ID NO: 898974 - protein, 102 aa, Homo sapiens; identical to SEQ ID NO: 898972

SEQ ID NO: 898975 - protein, 101 aa, Homo sapiens
VDRSLTLLPRPGCSSSILDRCSLHLLGSGNSPASASSAAGTTGAHHHARLIFVFLVEMGFHHVGQADLKLLTSMILPPQPPILVYLIRLCVTQCCKALTSV

SEQ ID NO: 898976 - protein, 516 aa, Homo sapiens
HRKPLPCEAADREQRPQVRAPWLRSGPGRCKALAVRACLVAVNPARGPGPRGARSGKFFHNLMERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQWDFASYDILRVIKTPEIANLALLGFGDIFALLFDNRYLYIMDLRTESLISRWPLPEYRKSKRGSSFLAGEASWLNGLDGHNDTGLVFATSMPDHSIHLVLWKEHG

SEQ ID NO: 898977 - protein, 516 aa, Homo sapiens; identical to SEQ ID NO: 898976

SEQ ID NO: 898978 - protein, 944 aa, Homo sapiens
MSGEDCAVPWKVDLIGQLFSSVLSLGEASPGLAGLHIVSGGARNPDFYLKSWIFKTLQLIKENLKEGEPNKTCPWVARLCPPPSLKLGNFVIQQLEMLVVTIRERVEGASSRKISAALQLSPLVLQGWWGGMYFIHRPKEGSLKMNIRIGTSVTAYVWEHELFLLADSSIKHIHFTGEKKGAGRAENDVNSRVGTFSCRICISIEPDSGPLSAVKLIEINGEFQGQISLISMLKLCGVKQKNNIFPHPTKSGFNLSHIEFCASALLSTLEIEPESQLNLFCRSPRRLWALMMVNDFLLYYYFFFFETEFRSYCAGWSAMARSWLTATSASWVQVILLPQPPEVAGITSICHDTQLIFIFLVETGFHHVGQAGLESPDLRSSTCLGLPKCWDYRREPPRLAEFLLFIEPEQITITDLMTIPTLPHFQIYPIASKGSNYNHLWEKFYEKVTNLKLYIVCSISVFSGEYRSHQGGTWCRWNFFFFLGSLALSYRLEYSGIIMQLDFDSRTSGSNWSPNVSFFLMEAFIWPEILFNYFIDAGFIHTIASFYKNGKLLILFAKESKVGSQNEKWIGDNLNYSLLSFHCLGELALAHTDFGFLQRIGKGIAFPSFVNILISEKFYSHEKISPILSYKDWISWVHCGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRLHFIFRSLKIALFWLLKTLGVRFEGGLYNHSSIHRKMITALYLYNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSELRLQARATTPSYFCIFSRDEVSLCWPGWS

SEQ ID NO: 898979 - protein, 902 aa, Homo sapiens
MPDFYLKSWIFKTLQLIKENLKEGEPNKTCPWVARLCPPPSLKLGNFVIQQLEMLVVTIRERVEGASSRKISAALQLSPLVLQGWWGGMYFIHRPKEGSLKMNIRIGTSVTAYVWEHELFLLADSSIKHIHFTGGEKGLLAELRMMGTLEWGPISCRICISIEPDSGPLSAVKLIEINGEFQGQISLISMLKLCGVKQKNNIFPHPTKSGFNLSHIEFCASALLSTLEIEPESQLNLFCRSPRRLWALMMVNDFLLYYYFFFFETEFRSYCAGWSAMARSWLTATSASWVQVILLPQPPEVAGITSICHDTQLIFIFLVETGFHHVGQAGLEPPDLRSSTCLGLPKCWDYRREPPRLAEFLLFIEPEQITITDLMTIPTLPHFQIYPIASKGKYYNHLWEKFYEKVTNLKLYIVCSISVFSGEYRSHQGGTWCRWNFFFFLGSLALSYRLEYSGIIMQLDFDSRTSGSNWSPNVKFFLMEAFIWPEILFNYFIDAGFIHTIASFYKNGKLLILFAKESKVGSQNEKWIGDNLNYSLLSFHCLGELALAHTDFGFLSSIGKGIAFPSFVNILISEKFYSHEKISPILSYKDWISWVHCGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRFALHFSYLKIALFWLLKTLGVRFECGLYNHSSIHRKMITALYLYNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSMLRLQARATTPSYFCIFSRDEVSLCWPGWS

SEQ ID NO: 898980 - protein, 902 aa, Homo sapiens; identical to SEQ ID NO: 898979

SEQ ID NO: 898981 - protein, 873 aa, Homo sapiens
MSLGCQIVSSSLSKVREFCDSAVEMLVVTIRERVEGASSRKISAALQLSPLVLQGWWGGMYFIHRPKEGSLKMNIRIGTSVTAYVWEHELFLLADSSIKHIHFTGGEKGLLAELRMMGTLEWGPISCRICISIEPDSGPLSAVKLIEINGEFQGQISLISMLKLCGVKQKNNIFPHPTKSGFNLSHIEFCASALLSTLEIEPESQLNLFCRSPRRLWALMMVNDFLLYYYFFFFETEFRSYCAGWSAMARSWLTATSASWVQVILLPQPPEVAGITSICHDTQLIFIFLVETGFHHVGQAGLESPDLRSSTCLGLPKCWDYRREPPRLAEFLLFIEPEQITITDLMTIPTLPHFQIYPIASKGSNYNHLWEKFYYKVTNLKLYIVCSISVFSGEYRSHQGGTWCRWNFFFFLGSLALSYRLEYSGIIMQLDFDSRTSGSNWSPNVKFFLMEAFIWPEILFNYFIDAGFIHTIASFYKNGKQLILFAKESKVGSQNEKWIGDNLNYSLLSFHCLGELALAHTDFGFLSSIGKGIAFPSFVNILISEKFYSHEKISPILSYKDWISWVHCGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRLHFIFRSLKIALFWLLKTLGVRFEGGLYNHSSIHRKMITALYLKNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSELRLQARATTPSYFCIFSRDEVSLCWPGWS

SEQ ID NO: 898982 - protein, 726 aa, Homo sapiens
MLVVTIRERVEGASSRKISAALQLSPLVLQGWWGGMYFIHRPKEGSLKMNIRIGTSVTAYVWEHELFLLADSSIKHIHFTGEKKGAGRAENDVNSRVGTFSCRICISIEPDSGPLSAVKLIEINGEFQGQISLISMLKLCGVKQKNNIFPHPTKSGFNLSHIEFCASALLSTLEIEPESQLNLFCRSPRRLWALMMVNDFLLYYYFFFFETEFRSYCAGWSAMARSWLTATSASWVQVILLPQPPEVAGITSICHDTQLIFIFLVETGFHHVGQAGLESPDLRSSTCLGLPKCWDYRREPPRLAEFLLFIEPEQITITDLMTIPTLPHFQIYPIASKGSNYNHLWEKFYEKVTNLKLYIVCSISVFSGEYRSHQGGTWCRWNFFFFLGSLALSYRLEYSGIIMQLDFDSRTSGSNWSPNVKFFLMEAFIWPEILFNYFIDAGFIHTIASFYKNGKLLILFAKESKVGSQNEKWIGDNLNYSLLSFHCLGELALAHTDFGFLSSIGKGIAFPSFVNILISEKFYSHEKISPILSYKDWISWVTLGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRLHFIFRSLKIALFWLLKTLGVRFEGGLYNHSSIHRKMITVSICKTKEITFGNSILDMRKLFVLGILI

SEQ ID NO: 898983 - protein, 628 aa, Homo sapiens
MARSWLTATSASWVQVILLPQPPEVAGITSICHDTQLIFIFLVETGFHHVGQAGLESPDLRSSTCLGLPKCWDYRREPPRLAEFLLFIEPEQITITDLMTIPTLPHFQIYPIASKGKIIIIICGKSFIKKVTNLKLYIVCSISVFSGEYRSHQGGTWCRWNFFFFLGSLALSYRLEYSGIIMQLDFDSRTSGSNWSPNVSSSFMEAFIWPEILFNYFIDAGFIHTIASFYKNGKLAHPFCKRKQSGESDMRSGLGITKTILYSPFIAFESSALAHTDFGFLSSIGKGIAFPSFVNILISEKFYSHEKISPILSYKDWISWVTLWCGGSSGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRLHFIFRSLKIALFWLLKTLGVRFEGGLYNHSSIHRKMITALYLYNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSELRLQARATTPSYFCIFSRDEVSLCWPGWS

SEQ ID NO: 898984 - protein, 578 aa, Homo sapiens
MLARLVLNSCLRSSTCLGLPKCWDYRREPPRLAEFLLFIEPEQITITDLMTIPTLPHFQIYPIASKGSNYNHLWEKFYEKVTNLKLYIVCSISVFSGEYRSHQGGTWCRWNFFFFLGSLALSYRLEYSGIIMQLDFDSRTSGSNWSPNVKFFLMEAFIWPEILFNYFIDAGFIHTIASFYKNGKLAHPFCKKKAKWGVRMRSGLGITKTILYSPFIAFESSALAHTDFGFLQRIGKGIAFPSFVNILISEKFYSHEKISPILSYKDWISWVHCGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRLHFIFRSLKIALFWLLKTLGVRFEGGLYNHSSIHRKMITALYLYNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSELRLQARATTPSYFCIFSRDEVSLCWPGWS

SEQ ID NO: 898985 - protein, 516 aa, Homo sapiens; identical to SEQ ID NO: 898976

SEQ ID NO: 898986 - protein, 516 aa, Homo sapiens; identical to SEQ ID NO: 898976

SEQ ID NO: 898987 - protein, 356 aa, Homo sapiens
HRKPLPCEAADREQRPQVRAPWLRSGPGRCKALAVRACLVAVNPARGPGPRGARSGKFFHNLMERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVGRLGRSLLLIRLFEGGRGGW

SEQ ID NO: 898988 - protein, 902 aa, Homo sapiens; identical to SEQ ID NO: 898979

SEQ ID NO: 898989 - protein, 1011 aa, Homo sapiens
MTRRIPEPNLTSSFASNLICSLRQVNFLFYDHHFLHLLSEGIVLDEGSQTQMPKGAVQDNINEYKHSGEDCAVPWKVDLIGQLFSSVLSLGEASPGLAGLHIVSGGARNPDFYLKSWIFKTLQLIKENLKEGEPNKTCPWVARLCPPPSLKLGNFVIQQLEMLVVTIRERVEGASSRKISAALQLSPLVLQGWWGGMYFIHRPKEGSLKMNIRIGTSVTAYVWEHELFLLADSSIKHIHFTGGEKGLLAELRMMGTLEWGPISCRICISIEPDSGPLSAVKLIEINGEFQGQISLISMLKLCGVKQKNNIFPHPTKSGFNLSHIEFCASALLSTLEIEPESQLNLFCRSPRRLWALMMVNDFLLYYYFFFFETEFRSYCAGWSAMARSWLTATSASWVQVILLPQPPEVAGITSICHDTQLIFIFLVETGFHHVGQAGLESPDLRSSTCLGLPKCWDYRREPPRLAEFLLFIEPEQITITDLMTIPTLPHFQIYPIASKGSNYNHLWEKFYEKVTNLKLYIVCSISVFSGEYRSHQGGTWCRWNFFFFLGSLALSYRLEYSGIIMQLDFDSRTSGSNWSPNVKFFLMEAFIWPEILFNYFIDAGFIHTIASFYKNGKLAHPFCKKKAKWGVRMRSGLGITKTILYSPFIAFESSALAHTDFGFLQRIGKGIAFPSFVNILISEKFYSHEKISPILSYKDWISWVTLGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRLHFIFRSLKIALFWLLKTLGVRFEGGLYNHSSIHRKMITALYLYNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSELRLQARATTPSYFCIFSRDEVSLCWPGWS

SEQ ID NO: 898990 - protein, 902 aa, Homo sapiens; identical to SEQ ID NO: 898979

SEQ ID NO: 898991 - protein, 902 aa, Homo sapiens; identical to SEQ ID NO: 898979

SEQ ID NO: 898992 - protein, 628 aa, Homo sapiens; identical to SEQ ID NO: 898983

SEQ ID NO: 898993 - protein, 578 aa, Homo sapiens
MLARLVLNSCLRSSTCLGLPKCWDYRREPPRLAEFLLFIEPEQITITDLMTIPTLPHFQIYPIASKGSNYNHLWEKFYEKVTNLKLYIVCSISVFSGEYRSHQGGTWCRWNFFFFLGSLALSYRLEYSGIIMQLDFDSRTSGSNWSPNVKFFLMEAFIWPEILFNYFIDAGFIHTIASFYKNGKLAHPFCKKKAKWGVRMRSGLGITKTILYSPFIAFESSALAHTDFGFLQRIGKGIAFPSFVNILISEKFYSHEKISPILSYKDWISWVHCGVVEASGFFQVHKGHHNNFRLHGVDRDPGELSGCVKFLIDSVIIPKECSFLQLNAFEVIHIAKSDCNLTFETYWRNRKKAPPVEGLDLEEVLQEGACNWIAVHEVKRGEHCYEIVRFALHFSSLKIALFWLLKTLGVRFEGGLYNHSSIHRKMITALYLYNKRNNFRKQYFRHEEIVCIRHFDLTESAKDEWILALHISLTKPSWQLEVVTVWLPDCLEVNPTNITVFFVLFCFFCMFLRQVLLYPQAGVQWRDLGLLQPQPPGFKRFSCLSLLSELRLQARATTPSYFCIFSRDEVSLCWPGWS

SEQ ID NO: 898994 - protein, 516 aa, Homo sapiens; identical to SEQ ID NO: 898976

SEQ ID NO: 898995 - protein, 516 aa, Homo sapiens; identical to SEQ ID NO: 898976

SEQ ID NO: 898996 - protein, 167 aa, Homo sapiens
MERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTGKRC

SEQ ID NO: 898997 - protein, 655 aa, Homo sapiens
LYWSGILGSAGTMEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 898998 - protein, 676 aa, Homo sapiens
CQEGQGQLRTTEPVGMRQERQSRACQAAGTMCKGMAEQSLLGTRAQAAQHLALVQWGNGVLVSAGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 898999 - protein, 510 aa, Homo sapiens
LYWSGILGSAGTMEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSERLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899000 - protein, 135 aa, Homo sapiens
LYWSGILGSAGTMEPVPLQDFVRALDPASLPRVLRVCSGVYFEGSIYEISGNECCLSTGDLIKVTQVRLQKVVCENPKTSQTMELAPNFQVFSSLRIAATRSAAQTQGEDLARVHQGWLQYVQQDSCPQEGPQAR

SEQ ID NO: 899001 - protein, 518 aa, Homo sapiens
LYWSGILGSAGTMEPVPLQDFVRALDPASLPRVLRVCSGVYFEGSIYEISGNECCLSTGDLIKVTQVRLQKVVCENPKTSQTMELAPNFQVRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899002 - protein, 655 aa, Homo sapiens; identical to SEQ ID NO: 898997

SEQ ID NO: 899003 - protein, 291 aa, Homo sapiens
GCTGPGFWDPRGPWSRCRCRTSCAPWTPPPSRACCGSARGSTSRRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899004 - protein, 272 aa, Homo sapiens
LYWSGILGSAGTMEPVPLQDFVRALDPASLPRVLRVCSGVYFEGSIYEISGNECCLSTGDLIKVTQVRLQKVVCENPKTSQTMELAPNFQGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHIFSSLRIAATRSAAQTQGEDLARVHQGWLQYVQQDSCPQEGPQAR

SEQ ID NO: 899005 - protein, 190 aa, Homo sapiens
CQEGQGQLRTTEPVGMRQERQSRACQAAGTMCKGMAEQSLLGTRAQAAQHLALVQWGNGVLVSAGSIYEISGNECCLSTGDLIKVTQVRLQKVVCENPKTSQTMELAPNFQGKVGTSASPCALALSWHTRRLLVGLPRPAVTPSPRGLLPRPSHSPQPSLKGGDVLRGSAMPWTQRGCTLSLSVSGHTCL

SEQ ID NO: 899006 - protein, 608 aa, Homo sapiens
LYWSGILGSAGTMEPVPLQDFVRALDPASLPRVLRVCSGVYFEGYFTPLNTPQSYETLEELVSATTQSSKQLPTCFMSTHRIVTEGRVVTEDQLLMLEAVVMHLGIRSARCVLGMEGQQVILHLPLSQKGPFWTWEPSAPRTLLQVLQDPALKDLVLTCPTLPWHSLILRPQYEIQAIMHMRRTIVKIPSTLEVDVEDVTASSRHVHFIKPLLLSEVLAWEGPFPLSMEILEVPEGRPIFLSPWVGSLQKGQRLCVYGLASPPWRVLASSKGRKVPRHFLVSGGYQGKLRRRPREFPTAYDLLGAFQPGRPLRVVATKDCEGEREENPEFTSLAVGDRLEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899007 - protein, 272 aa, Homo sapiens; identical to SEQ ID NO: 899004

SEQ ID NO: 899008 - protein, 255 aa, Homo sapiens
MRSKPSCTRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899009 - protein, 210 aa, Homo sapiens
MSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899010 - protein, 296 aa, Homo sapiens
AHSIGSPALTVLCGHHPEWPAWLESTYEVLGPGQAHGAQGSDVDVLVCQRLSDQAGEDEEEECKEEAESPERVLLPFHFPGSFVEEMSDSRRYSLADLTAQFSLPCEVKVVAKDTSHPTDPLTSFLGLRLEEKITEPFLVVSLDSEPGMCFEIPPRWLDLTVVEAKGQPDLPEGSLPIATVEELTDTFYYRLRKLPACEIQAPPPRPPKNQGLSKQRRHSSEGGVKSSQVLGLQQHARLPKPKAKTLPEFIKDGSSTYSKIPAHRKGHRPAKPQRQDLDDDEHDYEEILEQFQKTI

SEQ ID NO: 899011 - protein, 655 aa, Homo sapiens; identical to SEQ ID NO: 898997

SEQ ID NO: 899012 - protein, 770 aa, Homo sapiens
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899013 - protein, 777 aa, Homo sapiens
WIRAESVGTRPPLRQEAALMPLQGLGLQRNPFLQGKRGPGLTSSPPLLPPSLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899014 - protein, 754 aa, Homo sapiens
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899015 - protein, 767 aa, Homo sapiens
MEALRESVLHLALQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899016 - protein, 753 aa, Homo sapiens
MSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899017 - protein, 770 aa, Homo sapiens; identical to SEQ ID NO: 899012

SEQ ID NO: 899018 - protein, 770 aa, Homo sapiens; identical to SEQ ID NO: 899012

SEQ ID NO: 899019 - protein, 551 aa, Homo sapiens
ARITGVSHHTWPHGCLGGTVQPPGSLCRTWLAKPPTNSRPVDSGGAATEQFGVWALQVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899020 - protein, 277 aa, Homo sapiens
MEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899021 - protein, 770 aa, Homo sapiens; identical to SEQ ID NO: 899012

SEQ ID NO: 899022 - protein, 128 aa, Homo sapiens
MGATKWKHLERPLPSSGEARPRDGGGGSTCPPQPPLSRLSSPGLLAQPCLDSALPSPGKLESSCPRGSRRHRDTPATLGSASKLVQGIESGFQMEVLVPARSSPGSSAEETGTREVAEAEASRSPLAT

SEQ ID NO: 899023 - protein, 770 aa, Homo sapiens; identical to SEQ ID NO: 899012

SEQ ID NO: 899024 - protein, 125 aa, Homo sapiens
MAGPGSQDQSSPLVPYLRLQPPVSTPRRQPLLLDALGLRSALAQPCLDSALPSPGKLESSCPRGSRRHRDTPATLGSASKLVQGIESGFQMEVLVPARSSPGSSAEETGTREVAEAEASRSPLAT

SEQ ID NO: 899025 - protein, 146 aa, Homo sapiens
MVSAARGGLVRSSPASTVAGSGAAGGTRGRPGSRGAGRRLQQQPPPGSRKAWSRGAPGQSAALPAALRLVPSGAAAPSLVLVPAGCGGLGVPGSLWGRLLRSVLGCSEVPGLSLAWRPRAAGLGRARGWRRFRGAWMQLDLSVPGH

SEQ ID NO: 899026 - protein, 68 aa, Homo sapiens
FWRQDWWPAWQHWASSTRQVGAFVLHGGLDSLLHPAPSARARGASLLKPGQGSEAKEGARPRGVWVLR

SEQ ID NO: 899027 - protein, 770 aa, Homo sapiens; identical to SEQ ID NO: 899012

SEQ ID NO: 899028 - protein, 770 aa, Homo sapiens; identical to SEQ ID NO: 899012

SEQ ID NO: 899029 - protein, 754 aa, Homo sapiens; identical to SEQ ID NO: 899014

SEQ ID NO: 899030 - protein, 753 aa, Homo sapiens; identical to SEQ ID NO: 899016

SEQ ID NO: 899031 - protein, 722 aa, Homo sapiens
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRVWCSVRTPESSHEGLITDPHSPSRFRVIGSLSNSKEFSEHFRCPPGSPMNPPHKCEVW

SEQ ID NO: 899032 - protein, 474 aa, Homo sapiens
MTSFGMTSFGMTSFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899033 - protein, 379 aa, Homo sapiens
FQNKAWAPHGATSQQERGWETKGWGPASPLTCVFQTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 899034 - protein, 770 aa, Homo sapiens; identical to SEQ ID NO: 899012

SEQ ID NO: 899035 - protein, 128 aa, Homo sapiens; identical to SEQ ID NO: 899022

SEQ ID NO: 899036 - protein, 754 aa, Homo sapiens; identical to SEQ ID NO: 899014

SEQ ID NO: 899037 - protein, 297 aa, Homo sapiens
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVSVPLPSQPASQHGPSCSVSTPTPVQVFEARGAQGCQ

SEQ ID NO: 899038 - protein, 109 aa, Homo sapiens
MEPNSPKKIQFAVPVFQSQIAPEAAEQIRKRRPTPASLVILNEHNPPEIDDKRGPNTQGELQNASPKQRKQSVYTPPTIKGVKHLKGQNESAFPEEEEGTNEREEQRDH

SEQ ID NO: 899039 - protein, 1226 aa, Homo sapiens
TFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGEDGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 899040 - protein, 298 aa, Homo sapiens
MGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 899041 - protein, 1080 aa, Homo sapiens
TFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGEDGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPRCEAISCKKPNPVMNGSIKGSNYTYLSTLYYECDPGYVLNGTERRTCQDDKNWDEDEPICIPVDCSSPPVSANGQVRGDEYTFQKEIEYTCNEGFLLEGARSRVCLANGSWSGATPDCVPVRCATPPQLANGVTEGLDYGFMKEVTFHCHEGYILHGAPKLTCQSDGNWDAEIPLCKPVNCGPPEDLAHGFPNGFSFIHGGHIQYQCFPGYKLHGNSSRRCLSNGSWSGSSPSCLPCRCSTPVIEYGTVNGTDFDCGKAARIQCFKGFKLLGLSEITCEADGQWSSGFPHCEHTSCGSLPMIPNAFISETSSWKENVITYSCRSGYVIQGSSDLICTEKGVWSQPYPVCEPLSCGSPPSVANAVATGEAHTYESEVKLRCLEGYTMDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCESLFLSRGLDGAPL

SEQ ID NO: 899042 - protein, 135 aa, Homo sapiens
MITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 899043 - protein, 499 aa, Homo sapiens
TFSCKEGHVLQGPSVLKCLPSQQWNDSFPVCKIVLCTPPPLISFGVPIPSSALHFGSTVKYSCVGGFFLRGNSTTLCQPDGTWSSPLPECVPVECPQPEEIPNGIIDVQGLAYLSTALYTCKPGFELVGNTTTLCGEDGHWLGGKPTCKAIECLKPKEILNGKFSYTDLHYGQTVTYSCNRGFRLEGPSALTCLETGDWDVDAPSCNAIHCDSPQPIENGFVEGADYSYGAIIIYSCFPGFQVAGHAMQTCEESGWSSSIPTCMPIDCGLPPHIDFGDCTKLKDDQGYFEQEDDMMEVPYVTPHPPYHLGAVAKTWENTKESPATHSSNFLYGTMVSYTCNPGYELLGNPVLICQEDGTWNGSAPSCISIECDLPTAPENGFLRFTETSMGSAVQYSCKPGHILAGSDLRLCLENRKWSGASPQGEPSEDVEPHRYYMHKDGIQCKLDTKKHAPQRTRTRDPKRCEMAPRGGKAKMKKTGKSREHGGSNEDSSKATHIT

SEQ ID NO: 899044 - protein, 1226 aa, Homo sapiens; identical to SEQ ID NO: 899039

SEQ ID NO: 899045 - protein, 418 aa, Homo sapiens
MDTDTDTFTCQKDGRWFPERISCSPKKCPLPENITHILVHGDDFSVNRQVSVSCAEGYTFEGVNISVCQLDGTWEPPFSDESCSPVSCGKPESPEHGFVVGSKYTFESTIIYQCEPGYELEGNRERVCQENRQWSGGVAICKETRCETPLEFLNGKADIENRTTGPNVVYSCNRGYSLEGPSEAHCTENGTWSHPVPLCKPNPCPVPFVIPENALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 899046 - protein, 228 aa, Homo sapiens
MRRARWLNPVIPALCPQLRWQQNALLSEKEFYVDQNVSIKCREGFLLQGHGIITCNPDETWTQTSAKCEKISCGPPAHVENAIARGVHYQYGDMITYSCYSGYMLEGFLRSVCLENGTWTSPPICRAVCRFPCQNGGICQRPNACSCPEGWMGRLCEEPICILPCLNGGRCVAPYQCDCPPGWTGSRCHTAVCQSPCLNGGKCVRPNRCHCLSSWTGHNCSRKRRTGF

SEQ ID NO: 899047 - protein, 132 aa, Homo sapiens
CVKLAVDLLEDLPSPASAVFQPPHQRLDAFLSGPLGGDSHQLSEVSYTRLLANILLRNRTGSSHDSMSSREMRSSSRLDFCCVSSMLEGVGIESEKQKEVWESYSCLPVSLLKWWKMCKTKPMSLSFFLDGT

SEQ ID NO: 899048 - protein, 1078 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899049 - protein, 827 aa, Homo sapiens
GRGQRRSSLPGDAGLSGRRRGPGGGGSGVRVRSATFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899050 - protein, 591 aa, Homo sapiens
MEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899051 - protein, 435 aa, Homo sapiens
MRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899052 - protein, 645 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLSHFLRMNGIYCMLQ

SEQ ID NO: 899053 - protein, 110 aa, Homo sapiens
MTLFLALSSQEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899054 - protein, 933 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCPTPTSSISRRVFGFGVEIAYVGATILDVCKRVRKKDFWVGG

SEQ ID NO: 899055 - protein, 855 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGVVWGFVFSYMEVMTCENVAAQRKHSQCEGAGRRVMHCAGVGGGWST

SEQ ID NO: 899056 - protein, 557 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRK

SEQ ID NO: 899057 - protein, 330 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIR

SEQ ID NO: 899058 - protein, 83 aa, Homo sapiens
SGTFDWENLVIKDKFIRRWVHKEGFSGFKRYVTAAEDKELEAKIAVVEKYNIRIPELVQRIEKCHIEDLDFAGKGSSWFLPPP

SEQ ID NO: 899059 - protein, 1026 aa, Homo sapiens
RSRPEEELAAGGRWAERPAARARRRRQRGPGPERHSQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899060 - protein, 718 aa, Homo sapiens
MACGLSLPPCAPGLQGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899061 - protein, 1176 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAGKGSSWFLPPPKEEEQMVFCCSFFFLETEYGSVAQAGVQWRDLGSLQCPPSGFKQLSCLSLVSSWDYRPHHQPGKLVVFFVEMESHHVGQAGLELPTSEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 899062 - protein, 211 aa, Homo sapiens [sequence omitted]

SEQ ID NO: 899063 - protein, 911 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAGKGSSWFLPPP

SEQ ID NO: 899064 - protein, 638 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLTGECLSV

SEQ ID NO: 899065 - protein, 439 aa, Homo sapiens
RSRPEEELAAGGRWAERPAARARRRRQRGPGPERHMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNR

SEQ ID NO: 899066 - protein, 75 aa, Homo sapiens
ENPCSLVVPLSSLSCPSPQSNRKENKGGYLCHSCAEQRIGPLAFLTASPEQVRAMERTVENIVLPRHEALLFLVF

SEQ ID NO: 899067 - protein, 3697 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYGQELMGFPKAGCNHQHW

SEQ ID NO: 899068 - protein, 3552 aa, Homo sapiens
MSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPHFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYGQELMGFPKAGCNHQHW

SEQ ID NO: 899069 - protein, 3642 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILTSL

SEQ ID NO: 899070 - protein, 3697 aa, Homo sapiens; identical to SEQ ID NO: 899067

SEQ ID NO: 899071 - protein, 3697 aa, Homo sapiens; identical to SEQ ID NO: 899067

SEQ ID NO: 899072 - protein, 3697 aa, Homo sapiens; identical to SEQ ID NO: 899067

SEQ ID NO: 899073 - protein, 1082 aa, Homo sapiens
MEVDISSTFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 899074 - protein, 4164 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPVYHINEEADRRIRSSMERAVVYSLKTRATGVLYDYVNKYHWEHTGLTLREVSSKLRRNLQNNAEWVYQGAIRQIDDIDVRFQKAASGTTGTYQEWKDKANLSRRDQRQAFQDQDRLMVGEYQIHVKSALMII

SEQ ID NO: 899075 - protein, 3956 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPIADFELPTIIVPEQTIEIPSIKFSVPAGIVIPSFQALTARFEVDSPVYNATWSASSYTHPLILHHSSIPPPPPPLSLSHLSLHAFLPPQSPSLRLPSHSAITPPLLFPSSPLLPFLSSSTSVLVKLTP

SEQ ID NO: 899076 - protein, 2750 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHITRIPASPHLTHN

SEQ ID NO: 899077 - protein, 3697 aa, Homo sapiens; identical to SEQ ID NO: 899067

SEQ ID NO: 899078 - protein, 3677 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYGQELMGFPKAGCNHQHW

SEQ ID NO: 899079 - protein, 3630 aa, Homo sapiens
MLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILTSL

SEQ ID NO: 899080 - protein, 3697 aa, Homo sapiens; identical to SEQ ID NO: 899067

SEQ ID NO: 899081 - protein, 3697 aa, Homo sapiens; identical to SEQ ID NO: 899067

SEQ ID NO: 899082 - protein, 3697 aa, Homo sapiens; identical to SEQ ID NO: 899067

SEQ ID NO: 899083 - protein, 4034 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQAPKYK

SEQ ID NO: 899084 - protein, 3340 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISLRFGKNKTPNCRR

SEQ ID NO: 899085 - protein, 330 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSHRGSSSPRKRSYSSSSSSPERNRKRSRSRSSSSGDRKKRRTRSRSPERRHRSSSGSSHSGSRSSSKKK

SEQ ID NO: 899086 - protein, 320 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSRSSSRSHRGSSSPRKRSYSSSSSSPERNRKRSRSRSSSSGDRKKRRTRSRSPESQVIGENTKQP

SEQ ID NO: 899087 - protein, 107 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGFSSFGH

SEQ ID NO: 899088 - protein, 320 aa, Homo sapiens; identical to SEQ ID NO: 899086

SEQ ID NO: 899089 - protein, 257 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSRSRSRSSSSSQSRSRSSSRERSRSRGSKSR

SEQ ID NO: 899090 - protein, 257 aa, Homo sapiens; identical to SEQ ID NO: 899089

SEQ ID NO: 899091 - protein, 330 aa, Homo sapiens; identical to SEQ ID NO: 899085

SEQ ID NO: 899092 - protein, 257 aa, Homo sapiens; identical to SEQ ID NO: 899089

SEQ ID NO: 899093 - protein, 257 aa, Homo sapiens; identical to SEQ ID NO: 899089

SEQ ID NO: 899094 - protein, 330 aa, Homo sapiens; identical to SEQ ID NO: 899085

SEQ ID NO: 899095 - protein, 228 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIEREESDGEYDEFGRKKKKYRGKAVGPASILKEVEDKESEGEEEDEDEDLSKYKLDEDEDEDDADLSKYNLDASEEEDSNKKKSNRRSRSKSRSSHSRSSSRSSSPSSSRSRSR

SEQ ID NO: 899096 - protein, 320 aa, Homo sapiens; identical to SEQ ID NO: 899086

SEQ ID NO: 899097 - protein, 118 aa, Homo sapiens
SCGVAQAGLEFLDSSSLPVLASQSARIIGVSHYAWPVSPFTCQTANFTVFKFFLNPLFTKPVSHVVFHIDKHHYQYLIILLDFLFVNTTTALICGLGYCSFFLNGHLAFSRISVIFAK

SEQ ID NO: 899098 - protein, 555 aa, Homo sapiens
MSWNNSTWNYVYFPQEVVYKIHILILKWKDVVPKRKVLLMQLSAEFYNTIIFVYTLKSLKKKFKFYFDIVSRVLITHDENFKETKLKCLSRMFSWLIQKSSVEEAVSILPYKIFIVVINPVYFWSYLITKESSLFLLLMKCLICFSINEDPAPGPTGALLPHEKDLIQVHHLLLRGTEREVVLDLLHLVIAKKDEQDHGHPKVGFLRNKNGCSYVCLIDKVNFPSQGLDFYYLLCSDFLLFNFELQKNITLLILCTLIRLFRIVDQTILVIILLFKFLVPFIIFIANSRLFLSFEIAIQKLYVEVIYELTFILQASLNTNSQEFYEHLIKKLTFRSLGICPHLNMCKCISTANCFMPFVYKEIIPCSYYIFHFAVQIFFEKGLYYGYFICTDTFNIGRMQLSSVSLFCNRLLLSFINFLFVPNYIVILMALFVVFANFSYFIQLVKIKIMYKSINCWVQLVGLSHDSYLYRMISFASSHFGVEMLRFHTVLFLCICFFVKKITLFLSGIHSVAFLPLLQIFILATYNPPSLLSSKLNEHVLYSISQVIGENTKQP

SEQ ID NO: 899099 - protein, 257 aa, Homo sapiens; identical to SEQ ID NO: 899089

SEQ ID NO: 899100 - protein, 257 aa, Homo sapiens; identical to SEQ ID NO: 899089

SEQ ID NO: 899101 - protein, 257 aa, Homo sapiens; identical to SEQ ID NO: 899089

SEQ ID NO: 899102 - protein, 257 aa, Homo sapiens; identical to SEQ ID NO: 899089

SEQ ID NO: 899103 - protein, 119 aa, Homo sapiens
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGGGVYMKEKMSKISRYKSY

SEQ ID NO: 899104 - protein, 150 aa, Homo sapiens
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 899105 - protein, 205 aa, Homo sapiens
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVSALLSHTSIAEKAKELKMISGAAQLTIAKMWNQPNCPSSNEWIKKMWYIYTMEYYSATKRNVNNTLCSNLDGAGGLLS

SEQ ID NO: 899106 - protein, 150 aa, Homo sapiens; identical to SEQ ID NO: 899104

SEQ ID NO: 899107 - protein, 326 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 899108 - protein, 206 aa, Homo sapiens
CGVRMQTANRDTLAVEHYCRLRLMSLCHDTDVGELTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 899109 - protein, 128 aa, Homo sapiens
NIFRNIILPLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 899110 - protein, 145 aa, Homo sapiens [sequence omitted]

SEQ ID NO: 899111 - protein, 225 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGRATAVAQGLGGPEVLLPLRPGPSAT

SEQ ID NO: 899112 - protein, 220 aa, Homo sapiens
IPRVPFPGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 899113 - protein, 99 aa, Homo sapiens
PISEDPQPGTAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 899114 - protein, 109 aa, Homo sapiens
RGREVQAGTGSDFLGFPRGGGRGGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 899115 - protein, 379 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQEAASSVRTGGCPQESTTSCHKSKGPCRGMEHEVGDQRYGAWVSCGMLPCLAYDVAAISPMIRVADHKRLRVIHFTREGLGLEMEVAVSSGLHDRIGVRAKFSLPGGPRPRGVPGPRGDSPLGGAKKQRCSRGSSVAHSRERKPRTVDETADVRSQLGVSPTPLGELGPRGKQRVVKRRPK

SEQ ID NO: 899116 - protein, 795 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 899117 - protein, 795 aa, Homo sapiens; identical to SEQ ID NO: 899116

SEQ ID NO: 899118 - protein, 795 aa, Homo sapiens; identical to SEQ ID NO: 899116

SEQ ID NO: 899119 - protein, 659 aa, Homo sapiens
MINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 899120 - protein, 587 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESVSI

SEQ ID NO: 899121 - protein, 795 aa, Homo sapiens; identical to SEQ ID NO: 899116

SEQ ID NO: 899122 - protein, 795 aa, Homo sapiens; identical to SEQ ID NO: 899116

SEQ ID NO: 899123 - protein, 795 aa, Homo sapiens; identical to SEQ ID NO: 899116

SEQ ID NO: 899124 - protein, 701 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDLLVVWDALFADGLSLGLVDYIFVAMLLYIRDALISSNCQTAFSVLLTKALFLYC

SEQ ID NO: 899125 - protein, 348 aa, Homo sapiens
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGFCPWKNLETPRDNTLVK

SEQ ID NO: 899126 - protein, 424 aa, Homo sapiens
PQQLWLGSPDEVWLYLVCEHTHIFTAIIWDSRTRFGSTDFSFHPSIAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 899127 - protein, 390 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 899128 - protein, 400 aa, Homo sapiens
HSSCGWGAQMKCGSILYVSTPTFSLPLSGTAEPGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 899129 - protein, 201 aa, Homo sapiens [sequence omitted]

SEQ ID NO: 899130 - protein, 346 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKD

SEQ ID NO: 899131 - protein, 380 aa, Homo sapiens
MGATTMDQKSLWAGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 899132 - protein, 405 aa, Homo sapiens
PQQLWLGSPDEVWLYLVCEHTHIFTAIIWDSRTRFGSTDFSFHPSIAGVVVLLLLQGGSAYKLVCYFTNWSQDRQEPGKFTPENIDPFLCSHLIYSFASIENNKVIIKDKSEVMLYQTINSLKTKFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 899133 - protein, 371 aa, Homo sapiens
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 899134 - protein, 445 aa, Homo sapiens
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 899135 - protein, 69 aa, Homo sapiens
MFDRVQRGALVLGEVDGAQQAMGEKQDNLGPWEDQGGPMSLTVHQPADFLSACRLLCPSIRSPSACLCW

SEQ ID NO: 899136 - protein, 99 aa, Homo sapiens
QQRAPRELQRRWGPRRDWGPWFEGCSQAPRDSVPPLGALDLTLQDARLEAPQAPLLTDRDSASGSRGRGEALRDAQQVRVVSPGPALRVESRAWKPAAR

SEQ ID NO: 899137 - protein, 530 aa, Homo sapiens
MAQITYYACLLMATLSALVLCDILCTDVRHCLCVCNVLCLLCCVMWRGRSSGRRRRRRPGALFASLGVLLGPRPPPGIPRTRACSMGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 899138 - protein, 321 aa, Homo sapiens [sequence omitted]

SEQ ID NO: 899139 - protein, 373 aa, Homo sapiens
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRGMAGSGEVTHRRQVTPTAAPHQSFPFPVCRMGPVVLPPWLAGGIT

SEQ ID NO: 899140 - protein, 400 aa, Homo sapiens
LPLGIPPGLFLRVSDEDSQAPVVEPEDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 899141 - protein, 321 aa, Homo sapiens
MKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 899142 - protein, 146 aa, Homo sapiens
EPGGARSLVRRPRRQGGAGAAGGGGGGARERSSLPSGSCSDLGHRLGSPGLVRAAWAASGSRDRGRDPRSRGHRCPPSAGSRSARTTSPATSGWSSSAASTTSAAGHSGTQGAAASSATTALRTPRMPSVPSIKISILCASSYSPC

SEQ ID NO: 899143 - protein, 129 aa, Homo sapiens
AGRRTLARTAAAAAGRGRSSGRRRRRRPGALFASLGVLLGPRPPPGIPRTRACSMGGVGEPGPREGPAQPGAPLPTFCWEQIRAHDQPGDKWLVIERRVYDISRWAQRHPGGSRLIGHHGAEDATVRKP

SEQ ID NO: 899144 - protein, 82 aa, Homo sapiens
QPFRAPGTGLPSRLLTFLAPLPNIRPKIGWAGSTSSLSLGCSAQQEAAMENWVQEGQAHPGSCLDLALAALQLPYPTPVNPV

SEQ ID NO: 899145 - protein, 65 aa, Homo sapiens
GEFVVLLGEFVVLLGEFVVLLFFVLSVLESHWFVWITQMNHIPKEIGHEKHRDWVSSQVGSRGGA

SEQ ID NO: 899146 - protein, 373 aa, Homo sapiens; identical to SEQ ID NO: 899139

SEQ ID NO: 899147 - protein, 454 aa, Homo sapiens
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHQCQHTLPTPSLFPRMPRHNYSRVAPLVKSLCAKHGLSYEVKPFLTALVDIVRSLKKSGDIWLDAYLHQ

SEQ ID NO: 899148 - protein, 451 aa, Homo sapiens
QQRAPRELQRRWGPRRDWGPWFEGCSQAPRDSVPPLGALDLTLQDARLEAPQAPLLTDRDSASGSRGRGEALRDAQQDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 899149 - protein, 337 aa, Homo sapiens
MSALLQDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWAGPGKPLVRVDHTDEPHPQGDRPREAPGLGQLSAGSHLQRGALTFHQLVQRAPQLPDRAPPLPQDAETQLQPGGPAGQVAVCQARPQLRSEALPHRAGGHRQVPEEVW

SEQ ID NO: 899150 - protein, 140 aa, Homo sapiens
AGRRTLARTAAAAAGRGRSSGRRRRRRPGALFASLGVLLGPRPPPGIPRTRACSMGGVGEPGPREGPAQPGAPLPTFCWEQIRAHDQPGDKWLVIERRVYDISRWAQRHPGGSRLIGHHGAEDATVGHTGYQEGLQDPRT

SEQ ID NO: 899151 - protein, 100 aa, Homo sapiens
IYFKLLIFLLKGSTSSPVPRAMSSQQQQRQQQQCPPQRAQQQQVKQPCQPPPVKCQETCAPKTKDPCAPQVKKQCPPKGTIIPAQQKCPSAQQASKSKQK

SEQ ID NO: 899152 - protein, 66 aa, Homo sapiens
MSSQQQQRQQQQCPPQRAQQQQVKQPCQPPPVKCQETCAPKTKDPCAPQVKKQCPPKGTIIPAQQK

SEQ ID NO: 899153 - protein, 705 aa, Homo sapiens
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 899154 - protein, 705 aa, Homo sapiens; identical to SEQ ID NO: 899153

SEQ ID NO: 899155 - protein, 537 aa, Homo sapiens
GTPPTSPTAPTSPTAPTSPTAPTSPTAPTSPTAPTSPTVEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 899156 - protein, 581 aa, Homo sapiens
MQRRKQKQKNLNESHYLCMLLQSELSEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSK

SEQ ID NO: 899157 - protein, 574 aa, Homo sapiens
MQRRKQKQKNLNESHYLCMLLQSELSEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGKTTQFCVPNQYFFAFIY

SEQ ID NO: 899158 - protein, 687 aa, Homo sapiens
MQRRKQKQKNLNESHYLCMLLQSELSEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 899159 - protein, 705 aa, Homo sapiens; identical to SEQ ID NO: 899153

SEQ ID NO: 899160 - protein, 581 aa, Homo sapiens; identical to SEQ ID NO: 899156

SEQ ID NO: 899161 - protein, 123 aa, Homo sapiens
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIV

SEQ ID NO: 899162 - protein, 72 aa, Homo sapiens
SSKIKKIVHSIISSFAFGLFGVFLVLLDVTLVLADLIFTDSKLYIPSEYRSISLAIALFFLMDVLLRVFVEG

SEQ ID NO: 899163 - protein, 189 aa, Homo sapiens
WARRLRVGEVCGAGRPGGSPARASRDGPRSRGVCGGSTHTRKTSSSPAPGERASVCESECEERAAARRPAPPLEQLSKLRRRPGPAARPPRAGPLSLPAAGGPGEGPRAETPEAGAPHAARPPAPRPAPARVRVLLAPCCRLSRYLLLLPGLREMRESEPGRRNPSSGGGGRGGGSPPRGGPGSMCLSW

SEQ ID NO: 899164 - protein, 189 aa, Homo sapiens; identical to SEQ ID NO: 899163

SEQ ID NO: 899165 - protein, 133 aa, Homo sapiens
MSSEENKCVEQPQPPPPEEPGAPAPSPPAADKRPRGRPRKALPLSREPERNSAHLHPGEINSFIAHTKPVWWSLHTDAHEIWCRDLDRGTSLRRSIPCPPALCSVRKIHLRPQVLRPTSPRNISPISNLIYSA

SEQ ID NO: 899166 - protein, 189 aa, Homo sapiens; identical to SEQ ID NO: 899163

SEQ ID NO: 899167 - protein, 266 aa, Homo sapiens
LAQPSHLHTRCQHTRGRGAGGDLQPLSGAAPLQHQVRSLSGERLKVLDEDGGIGPADPLQLLNVGIRAHSNGHHLDVSRQPLDLIRGRISGDHGDQVGHLLPVTLADQEAVVGGVQQGHPSVGPVATLVADLSHPLQDVPFGLCLAEGVLHGHHVGVLQHRDVDAVLAHIHPLNHLLHELLAPVEVGFTNFVRSFQDKCHIQNHGVPLGPQGRKPQEPRAHSDLCHVGGQSRRRGVRGKVTEVANDLFPLLLQLIHTAQHEGLVLR

SEQ ID NO: 899168 - protein, 1016 aa, Homo sapiens
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTGSSAAVPGMNTLGPSNSSCPRVFPQAGNLMPMGPGHASVSSLPTNSGQQDRGVAQFPGSQNMPQSSLYGMASGITQIVAQPPPQATNGHAHIPRQTNVGQNTSVSAAYGQNSLGSSGLSQQHNKGTLNPGLTKPPVPRVSPAMGGQNSSWQHQGMPNLSGQTPGNSNVSPFTAASSFHMQQQAHLKMSSPQFSQAVPNRPMAPMSSAAAVGSLLPPVSAQQRTSAPAPAPPPTAPQQGLPGLSPAGPELGAFSQSPASQMGGRAGLHCTQAYPVRTAGQELPFAYSGQPGGSGLSSVAGHTDLIDSLLKNRTSEEWMSDLDDLLGSQ

SEQ ID NO: 899169 - protein, 396 aa, Homo sapiens
MKQHQLLLDQQKQREQQQKHLQQQQFLQRQQHLLAEQEKQQFQRHLTRPPPQYQDPTQGSFPQQVGQFTGSSAAVPGMNTLGPSNSSCPRVFPQAGNLMPMGPGHASVSSLPTNSGQQDRGVAQFPGSQNMPQSSLYGMASGITQIVAQPPPQATNGHAHIPRQTNVGQNTSVSAAYGQNSLGSSGLSQQHNKGTLNPGLTKPPVPRVSPAMGGQNSSWQHQGMPNLSGQTPGNSNVSPFTAASSFHMQQQAHLKMSSPQFSQAVPNRPMAPMSSAAAVGSLLPPVSAQQRTSAPAPAPPPTAPQQGLPGLSPAGPELGAFSQSPASQMGGRAGLHCTQAYPVRTAGQELPFAYSGQPGGSGLSSVAGHTDLIDSLLKNRTSEEWMSDLDDLLGSQ

SEQ ID NO: 899170 - protein, 1016 aa, Homo sapiens; identical to SEQ ID NO: 899168

SEQ ID NO: 899171 - protein, 1016 aa, Homo sapiens; identical to SEQ ID NO: 899168

SEQ ID NO: 899172 - protein, 601 aa, Homo sapiens
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQVSMSLCFLFLCCRHFSEVTHYFGC

SEQ ID NO: 899173 - protein, 708 aa, Homo sapiens
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTGRGCLCDEQGQGRPLPGAG

SEQ ID NO: 899174 - protein, 477 aa, Homo sapiens
MAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTGSSAAVPGMNTLGPSNSSCPRVFPQAGNLMPMGPGHASVSSLPTNSGQQDRGVAQFPGSQNMPQSSLYGMASGITQIVAQPPPQATNGHAHIPRQTNVGQNTSVSAAYGQNSLGSSGLSQQHNKGTLNPGLTKPPVPRVSPAMGGQNSSWQHQGMPNLSGQTPGNSNVSPFTAASSFHMQQQAHLKMSSPQFSQAVPNRPMAPMSSAAAVGSLLPPVSAQQRTSAPAPAPPPTAPQQGLPGLSPAGPELGAFSQSPASQMGGRAGLHCTQAYPVRTAGQELPFAYSGQPGGSGLSSVAGHTDLIDSLLKNRTSEEWMSDLDDLLGSQ

SEQ ID NO: 899175 - protein, 1016 aa, Homo sapiens; identical to SEQ ID NO: 899168

SEQ ID NO: 899176 - protein, 897 aa, Homo sapiens
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTGSSAAVPGMNTLGPSNSSCPRVFPQAGNLMPMGPGHASVSSLPTNSGQQDRGVAQFPGSQNMPQSSLYGMASGITQIVAQPPPQATNGHAHIPRQTNVGQNTSVSAAYGQNSLGSSGLSQQHNKGTLNPGLTKPPVPRVSPAMGGQNSSWQHQGMPNLSGQTPGNSNVSPFTAASGPFNASGPFNASGPFNASRPSRLRAITTPGILR

SEQ ID NO: 899177 - protein, 724 aa, Homo sapiens
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTAQGLSCALPMIHSTEVLISSLCNGSAGLSAAQRSW

SEQ ID NO: 899178 - protein, 487 aa, Homo sapiens
MGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 899179 - protein, 103 aa, Homo sapiens
PFLGLDRAGTGGQLGRSSSGSAGSRRKPAPLVQAELALASCLLLLNQDLAVRPPCSLLEPAGGNMGDTGLRKRREDEKSIQSQEPKTTSLQKEVPCALRSLAQ

SEQ ID NO: 899180 - protein, 553 aa, Homo sapiens
PFLGLDRAGTGGQLGRSSSGSAGSRRKPAPLVQAELALASCLLLLNQDLAVRPPCSLLEPAGGNMGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISSKYQQKGRLASVRCRQARRPHLS

SEQ ID NO: 899181 - protein, 551 aa, Homo sapiens
PFLGLDRAGTGGQLGRSSSGSAGSRRKPAPLVQAELALASCLLLLNQDLAVRPPCSLLEPAGGNMGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 899182 - protein, 468 aa, Homo sapiens
QTGVNQAGLNVQRWSSGPSSEGGPRWAPPYERSLRWEEGSLGPGQCLTRGLWALPLCVPGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 899183 - protein, 547 aa, Homo sapiens
PFLGLDRAGTGGQLGRSSSGSAGSRRKPAPLVQAELALASCLLLLNQDLAVRPPCSLLEPAGGNMGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHASAPAITLSFTLFPFTLKCACKWSPPP

SEQ ID NO: 899184 - protein, 1302 aa, Homo sapiens
MTQECPDLSLSLLSSRVKGERLHRTWTEQPLGLYLVGEKAAGQWRCVEGTLSTSLQALSPGAEMAVAPAPEAGVRYLVVAVERSWGLNDLGPPFITKVVGAWRQWRLMDRSSQPKGPPWLAWFCVTLKPESYNTSQEKIGEEARTPPGLPTGQEVGKGRKEMNGVSSQGSYLCLSLYSYIIRERDHWVHRDGEEATGLNFLFRRKCSPQAHCVRQVLGNGQRALSSSTLVGDQEGNSVAKGYFNLLFMIYSPLEQSLSGCCENTLHLWDDRVVSDPQDSIDVCGCSTEWCYPDQQSPQEVGATHTLIPLVGSCLQRGLPLGVPGRGDPCLWGRVSTGEVLAGGGSDVLVTWADLPTVPGCQNCSAVGPLHYSTSLKEGNFLPKLTLGNYSFNPLHQISYSSPPGFYPMRVKLCEADTSVCCSVAALKGLFLSIMDAGACLKSHSGPSLSQKRRMHKCNSWLFAGVGEHLLFEDGGGEGRNMIPPEVSHPGANSLPCSVSRLQMPPCPDETLQWLQEWSSLSFHLLWSGEVHCAYGRDRSGPAVMLGCGQGQGWMTQSVCLCISALFILSHFLHRLLFPAMGFWYEKGSSKWSQVLVGQGELDPSGKNHLQNDSPSGFFYHPILLGKEHLGGSWDAASPRQCQHFMGAEAEPRSSKKGHPESSSSVESLPVRTLRSSQSSHGHATHQGSMPDLFFTASLEEEQKPPFLKTIKTSKGTSLEMKCSTILAYVTRSPDYATRVPLPCPAAQELLSSSSPGVPALLIPHIPHLPQPRKQWGFSDAPPFVSLWLPLALCKLCKKLLPLLDVVDELPSTWLERWHIIQGQKVVQQCFCSGCREMEKKSPASLPPPTFLFHSSEFSSPVSCHVKRFFKMLLLLLDCLSLSSQGGDENVDTSPRLLPQPFHSRQKRLGQNKTSMIEEQGSPHNQVSPDGGWTGLVWLGKDSFKSVPEHLRAMSVMPKRATWPPWAPTLMAELHKRGSDVGMPDGGTLFSDKGLNPFHVAKQLSLPPLPPNPELGLVWAQHGCACEGSHISERKLHSPQGPRLAWGRCLLKSMSVSALGNPSRALVGNLASKEQGLGPPKEFTMMPGRVPEPGFQSAWLTEWGLGIPGQLSIHPISQGSGQGQLATGNQRLFCTVLPETVTLGKAPHFSGPQLPHLQNQSISCSPHDSLPVLIKSLCSGAHEGCEPGAPGSCLRGLVSFQPLMPRLGAGSHLVHAQMLPQTRTLGILTDSAFLSSWFVLPLLFLCNDETIIKGHLQWTIFKVLMGCHNLRYILSKSVSPTADEAGSFLISASGMTSVGELKI

SEQ ID NO: 899185 - protein, 1239 aa, Homo sapiens
MAVAPAPEAGVRYLVVAVERSWGLNDLGPPFITKVVGAWRQWRLMDRSSQPKGPPWLAWFCVTLKPESYNTSQEKIGEEARTPPGLPTGQEVGKGRKEMNGVSSQGSYLCLSLYSYIIRERDHWVHRDGEEATGLNFLFRRKCSPQAHCVRQVLGNGQRALSSSTLVGDQEGNSVAKGYFNLLFMIYSPLEQSLSGCCENTLHLWDDRVVSDPQDSKMFVDVALSGDTQTSSHPRKWGLPIPSFLWWGAACREACHWGFQAVVTLASGEGLAQGRFQLEEGSDVLVTWADLPTVPGCQNCSAVGPLHYSTSLKEGNFLPKLTLGNYSFNPLHQISYSSPPGFYPMRVKLCEADTSVCCSVAALKGLFLSIMDAGACLKSHSGPSLSQKRRMHKCNSWLFAGVGEHLLFEDGGWGRKEHDPSRSLPPWGQLTAMFSVPAPNAPLPRGNPAVVTGMELFVIPPPLVRRGSLCIWQRQEWPCSDVGLWAGTVMDDSERLSLYFCSVHSVPTFFIDSFSLQWVFGMKKAPVNGAKSWFDKGNLILQGRIISKMTPHLVSSTTQFYYGKEHLGGSWDAASPRQCQHFMGAEAEPRSSKKGHPESSSSVESLPVRTLRSSQSSHGHATHQGSMPDLFFTASLEEEQKPPFLKTIKTSKGTSLEMKCSTILAYVTRSPDMQTRVPLPCPAAQELLSSSSPGVPALLIPHIPHLPQPRKQWGFSDAPPFVSLWLPLALCKLCKKLLPLLDVVDELPSTWLERWHIIQGQKVVQQCFCSGCREMEKKSPASLPPPTFLFHSSEFSSPVSCHVKRFFKMLLLLLDCLSLSSQGGDENVDTSPRLLPQPFHSRQKRLGQNKTSMIEEQGSPHNQVSPDGGWTGLVWLGKDSFKSVPEHLRAMSVMPKRATWPPWAPTLMAELHKRGSDVGMPDGGTLFSDKGLNPFHVAKQLSLPPLPPNPELGLVWAQHGCACEGSHISERKLHSPQGPRLAWGRCLLKSMSVSALGNPSRALVGNLASKEQGLGPPKEFTMMPGRVPEPGFQSAWLTEWGLGIPGQLSIHPISQGSGQGQLATGNQRLFCTVLPETVTLGKAPHFSGPQLPHLQNQSISCSPHDSLPVLLKVSDLEHMRVASLVHLVPVSVGWFPSAPDAQAGCRLSSGPCPDAASDKNSGNPNRLCFLSSWFVLPLLFLCNDETIIKGHLQWTIFKVLMGCHNLRYILSKSVSPTADEAGSFLISASGMTSVGELKI

SEQ ID NO: 899186 - protein, 308 aa, Homo sapiens
MFNGEPGPASSGASRNVVRSSSISGEICGSQQAGGGAGTTTAKKRRSSLGAKMVAIVGLTQWSKSTLQLPQPEGATKKLRSNIRRSTETGIAVEMRSRVTRQGSRESTDGSTNSNSSDGTFIFPTTRLGAESQFSDFLDGLGPAQIVGRQTLATPPMGDVHIAIMDRSGQLEVEVIEARGLTPKPGSKSLPATYIKVYLLENGACLAKKKTKMTKKTCDPLYQQALLFDEGPQGKVLQVIVWGDYGRMDHKCFMGMAQIMLDELDLSAAVTGWYKLFPTSSVADSTLGSLTRRLSQSSLESATSPSCS

SEQ ID NO: 899187 - protein, 224 aa, Homo sapiens
MRLAKPKAGISRSSSQGKAYENKRKTGRQRQKWGMTIRFDSSFSRLRRSLDDKPYKCTECEKSFSQSSTLFQHQKIHTGKKSHKCADCGKSFFQSSNLIQHRRIHTGEKPYKCDECGESFKQSSNLIQHQRIHTGEKPYQCDECGRCFSQSSHLIQHQRTHTGEKPYQCSECGKCFSQSSHLRQHMKVHKEEKPRKTRGKNIRVKTHLPSWKAGTGRKSVAGLR

SEQ ID NO: 899188 - protein, 224 aa, Homo sapiens; identical to SEQ ID NO: 899187

SEQ ID NO: 899189 - protein, 206 aa, Homo sapiens
MVHARLPTGSRRQKWGMTIRFDSSFSRLRRSLDDKPYKCTECEKSFSQSSTLFQHQKIHTGKKSHKCADCGKSFFQSSNLIQHRRIHTGEKPYKCDECGESFKQSSNLIQHQRIHTGEKPYQCDECGRCFSQSSHLIQHQRTHTGEKPYQCSECGKCFSQSSHLRQHMKVHKEEKPRKTRGKNIRVKTHLPSWKAGTGRKSVAGLR

SEQ ID NO: 899190 - protein, 224 aa, Homo sapiens; identical to SEQ ID NO: 899187

SEQ ID NO: 899191 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 899192 - protein, 157 aa, Homo sapiens
RGQAAAGAVTRFPPRRSLGRCHGFGVGDRAVTMARLALSPVPSHWMVALLLLLSAEPVPAARSEDRYRNPKGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 899193 - protein, 256 aa, Homo sapiens
NYGLGARLGGGSLGRCHGFGVGDRAVTMARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 899194 - protein, 229 aa, Homo sapiens; identical to SEQ ID NO: 899191

SEQ ID NO: 899195 - protein, 229 aa, Homo sapiens; identical to SEQ ID NO: 899191

SEQ ID NO: 899196 - protein, 256 aa, Homo sapiens
MWRRHRVISCSACALMLYSGHRRTITSWRSLLVPSHWIGRTYSLLAATQLEPATNMAKIRRTGYRNRSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 899197 - protein, 261 aa, Homo sapiens
RGQAAAGAVTRFPPRRSLGRCHGFGVGDRAVTMARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 899198 - protein, 270 aa, Homo sapiens
NYGLGARLGGGSLGRCHGFGVGDRAVTMARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEAGLLTEGPMGPCARRPGLSGWVSPAGVTGPLLGGPAGGRAGRPLRP

SEQ ID NO: 899199 - protein, 229 aa, Homo sapiens; identical to SEQ ID NO: 899191

SEQ ID NO: 899200 - protein, 229 aa, Homo sapiens; identical to SEQ ID NO: 899191

SEQ ID NO: 899201 - protein, 94 aa, Homo sapiens
LGRCHGFGVGDRAVTMARLALSPVPSHWMVALLLLLSGTEPTTRPVGFALISSCLGPAALPPACSTLLLCLSLFTACLPLMALGPGSVGVSCTW

SEQ ID NO: 899202 - protein, 156 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSANNPSHTPSLGPHLPACL

SEQ ID NO: 899203 - protein, 105 aa, Homo sapiens
MATANSIIVLDDDDEDEAAAQPGPSHPLPNAASPGAEAPSSSEPHGARGSSSSGGKKCYKLENEKLFEEVSFSGEDCCTPGRGMADWFSCPFFPTNPTSPFSQPP

SEQ ID NO: 899204 - protein, 760 aa, Homo sapiens [sequence omitted]

SEQ ID NO: 899205 - protein, 740 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899206 - protein, 752 aa, Homo sapiens
MRGSENCGEGRLERRFLSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899207 - protein, 665 aa, Homo sapiens
MQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899208 - protein, 744 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKVRRGGRVSSDNLFSFIGCFSCSV

SEQ ID NO: 899209 - protein, 372 aa, Homo sapiens
MSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899210 - protein, 363 aa, Homo sapiens
CCFFLFVLLFIILLTLLHLFQILSSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899211 - protein, 711 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAAVPNPPFTASSAWYLQDKCGHTMRSRRDHRALRL

SEQ ID NO: 899212 - protein, 672 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSGCPKPPIHSLLGLVLARQVWPHNAIQKRSSCSQTLISCLPFSLPPECSGITFGGRWEADD

SEQ ID NO: 899213 - protein, 294 aa, Homo sapiens
GSRHPWDAIPLGPSPESKEASGVSSASRAETDDEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899214 - protein, 489 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAG

SEQ ID NO: 899215 - protein, 435 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAER

SEQ ID NO: 899216 - protein, 70 aa, Homo sapiens
AAAYYYYSTARIQASNDVRGHGLVTSSLCIPSPARLSQTPHSQPPRPGTCKTSVATQCDPEEIIVLSDSD

SEQ ID NO: 899217 - protein, 740 aa, Homo sapiens; identical to SEQ ID NO: 899205

SEQ ID NO: 899218 - protein, 740 aa, Homo sapiens; identical to SEQ ID NO: 899205

SEQ ID NO: 899219 - protein, 740 aa, Homo sapiens; identical to SEQ ID NO: 899205

SEQ ID NO: 899220 - protein, 665 aa, Homo sapiens
MATANSIIVLDDDDEDEQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 899221 - protein, 776 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKISLTLCLSLPCRQVWPHNAIQKRSSCSQTLISCLPFSLPPECSGITFGGRWEADD

SEQ ID NO: 899222 - protein, 372 aa, Homo sapiens; identical to SEQ ID NO: 899209

SEQ ID NO: 899223 - protein, 659 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKR

SEQ ID NO: 899224 - protein, 602 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETSVATQCDPEEIIVLSDSD

SEQ ID NO: 899225 - protein, 598 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPMWKGKGQCMRRMGKRYVPCPAHLPPWLPWPQLLIPPRGWTLPAMAW

SEQ ID NO: 899226 - protein, 401 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKCGHTMRSRRDHRALRL

SEQ ID NO: 899227 - protein, 63 aa, Homo sapiens
MASQGCPSASRAETDDEDDEESDEEEEEEEEEEEEEATDSEEEEDLEQMQEGQEDDEEEDEEE

SEQ ID NO: 899228 - protein, 536 aa, Homo sapiens
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 899229 - protein, 594 aa, Homo sapiens
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 899230 - protein, 536 aa, Homo sapiens; identical to SEQ ID NO: 899228

SEQ ID NO: 899231 - protein, 548 aa, Homo sapiens
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 899232 - protein, 194 aa, Homo sapiens [sequence omitted]

SEQ ID NO: 899233 - protein, 594 aa, Homo sapiens; identical to SEQ ID NO: 899229

SEQ ID NO: 899234 - protein, 355 aa, Homo sapiens
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYHTRTTGYRA

SEQ ID NO: 899235 - protein, 179 aa, Homo sapiens
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLGREPSEQDWHLGMLMCN

SEQ ID NO: 899236 - protein, 588 aa, Homo sapiens
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 899237 - protein, 594 aa, Homo sapiens; identical to SEQ ID NO: 899229

SEQ ID NO: 899238 - protein, 594 aa, Homo sapiens; identical to SEQ ID NO: 899229

SEQ ID NO: 899239 - protein, 536 aa, Homo sapiens; identical to SEQ ID NO: 899228

SEQ ID NO: 899240 - protein, 594 aa, Homo sapiens; identical to SEQ ID NO: 899229

SEQ ID NO: 899241 - protein, 234 aa, Homo sapiens
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQVLGHNRSLLK

SEQ ID NO: 899242 - protein, 1327 aa, Homo sapiens
MTLDRPGEGATMLKTFTVLLFCILMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI
